United States Patent
Seth et al.

(10) Patent No.: US 10,570,169 B2
(45) Date of Patent: Feb. 25, 2020

(54) CONJUGATED ANTISENSE COMPOUNDS AND THEIR USE

(71) Applicant: Ionis Pharmaceuticals, Inc., Carlsbad, CA (US)

(72) Inventors: Punit P. Seth, Carlsbad, CA (US); Thazha P. Prakash, Carlsbad, CA (US); Michael T. Migawa, Carlsbad, CA (US); Eric E. Swayze, Encinitas, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 15/311,436

(22) PCT Filed: May 21, 2015

(86) PCT No.: PCT/US2015/032045
§ 371 (c)(1),
(2) Date: Nov. 15, 2016

(87) PCT Pub. No.: WO2015/179693
PCT Pub. Date: Nov. 26, 2015

(65) Prior Publication Data
US 2017/0355727 A1 Dec. 14, 2017

Related U.S. Application Data

(60) Provisional application No. 62/062,770, filed on Oct. 10, 2014, provisional application No. 62/032,270, filed on Aug. 1, 2014, provisional application No. 62/002,133, filed on May 22, 2014.

(51) Int. Cl.

| | | |
|---|---|---|
| *A01N 43/04* | (2006.01) |
| *A61K 31/70* | (2006.01) |
| *C07H 21/00* | (2006.01) |
| *C12N 15/113* | (2010.01) |
| *C07H 13/08* | (2006.01) |
| *C07H 15/04* | (2006.01) |
| *C07H 15/14* | (2006.01) |
| *C07H 19/056* | (2006.01) |
| *C07H 19/06* | (2006.01) |
| *C07H 19/16* | (2006.01) |
| *C12P 19/34* | (2006.01) |
| *A61K 39/00* | (2006.01) |

(52) U.S. Cl.
CPC ............ *C07H 21/00* (2013.01); *C07H 13/08* (2013.01); *C07H 15/04* (2013.01); *C07H 15/14* (2013.01); *C07H 19/056* (2013.01); *C07H 19/06* (2013.01); *C07H 19/16* (2013.01); *C12N 15/113* (2013.01); *C12P 19/34* (2013.01); *A61K 39/00* (2013.01); *C12N 2310/11* (2013.01); *C12N 2310/315* (2013.01); *C12N 2310/321* (2013.01); *C12N 2310/3341* (2013.01); *C12N 2310/351* (2013.01); *C12N 2310/3525* (2013.01)

(58) Field of Classification Search
None
See application file for complete search history.

(56) References Cited

U.S. PATENT DOCUMENTS

| | | |
|---|---|---|
| 4,751,219 A | 6/1988 | Kempen |
| 4,845,205 A | 7/1989 | Huynh et al. |
| 5,034,506 A | 7/1991 | Summerton et al. |
| 5,130,302 A | 7/1992 | Spielvogel et al. |
| 5,134,066 A | 7/1992 | Rogers et al. |
| 5,166,315 A | 11/1992 | Summerton et al. |
| 5,175,273 A | 12/1992 | Bischofberger et al. |
| 5,185,444 A | 2/1993 | Summerton et al. |
| 5,367,066 A | 11/1994 | Urdea et al. |
| 5,432,272 A | 7/1995 | Benner et al. |
| 5,457,187 A | 10/1995 | Gmeiner et al. |
| 5,459,255 A | 10/1995 | Cook et al. |
| 5,484,908 A | 1/1996 | Froehler et al. |
| 5,502,177 A | 3/1996 | Matteucci et al. |
| 5,508,040 A | 4/1996 | Chen |
| 5,525,711 A | 6/1996 | Hawkins et al. |
| 5,552,540 A | 9/1996 | Haralambidis |
| 5,587,469 A | 12/1996 | Cook et al. |
| 5,594,121 A | 1/1997 | Froehler et al. |
| 5,595,978 A | 1/1997 | Draper et al. |
| 5,596,091 A | 1/1997 | Switzer |
| 5,614,617 A | 3/1997 | Cook et al. |
| 5,645,985 A | 7/1997 | Froehler et al. |
| 5,672,359 A | 9/1997 | Digenis et al. |
| 5,674,530 A | 10/1997 | Amidon et al. |
| 5,681,941 A | 10/1997 | Cook et al. |

(Continued)

FOREIGN PATENT DOCUMENTS

| | | |
|---|---|---|
| WO | WO 1985/002092 | 5/1985 |
| WO | WO 1994/014226 | 6/1994 |

(Continued)

OTHER PUBLICATIONS

Mamidyala et al. JACS (2012), vol. 134, pp. 1978-1981.*

(Continued)

*Primary Examiner* — Patrick T Lewis

(74) *Attorney, Agent, or Firm* — Knobbe, Martens, Olson & Bear, LLP

(57) ABSTRACT

Provided herein are oligomeric compounds with conjugate groups. In certain embodiments, the gomeric compounds are conjugated to N-Acetylgalactosamine or to N-Acetylgalactosamine analogues.

18 Claims, No Drawings
Specification includes a Sequence Listing.

(56) References Cited

U.S. PATENT DOCUMENTS

| | | |
|---|---|---|
| 5,686,105 A | 11/1997 | Kelm et al. |
| 5,698,685 A | 12/1997 | Summerton et al. |
| 5,705,188 A | 1/1998 | Yano et al. |
| 5,750,692 A | 5/1998 | Cook et al. |
| 5,763,588 A | 6/1998 | Matteueci et al. |
| 5,814,336 A | 9/1998 | Kelm et al. |
| 5,830,653 A | 11/1998 | Froehler et al. |
| 5,840,329 A | 11/1998 | Bai |
| 5,994,517 A | 11/1999 | Ts'o et al. |
| 6,005,096 A | 12/1999 | Matteucci et al. |
| 6,117,450 A | 9/2000 | Dittgen et al. |
| 6,268,490 B1 | 7/2001 | Imanishi et al. |
| 6,300,319 B1 | 10/2001 | Manoharan |
| 6,383,812 B1 | 5/2002 | Chen et al. |
| 6,525,031 B2 | 2/2003 | Manoharan |
| 6,525,191 B1 | 2/2003 | Ramasamy |
| 6,620,916 B1 | 9/2003 | Takahara et al. |
| 6,660,720 B2 | 12/2003 | Manoharan |
| 6,670,461 B1 | 12/2003 | Wengel et al. |
| 6,727,064 B2 | 4/2004 | Karras |
| 6,770,748 B2 | 8/2004 | Imanishi et al. |
| 6,794,499 B2 | 9/2004 | Wengel et al. |
| 6,906,182 B2 | 6/2005 | Ts'o et al. |
| 6,908,903 B1 | 6/2005 | Theodore et al. |
| 7,034,133 B2 | 4/2006 | Wengel et al. |
| 7,053,207 B2 | 5/2006 | Wengel |
| 7,259,150 B2 | 8/2007 | Crooke et al. |
| 7,262,177 B2 | 8/2007 | Ts'o et al. |
| 7,399,845 B2 | 7/2008 | Swayze et al. |
| 7,399,853 B2 | 7/2008 | Freier et al. |
| 7,425,544 B2 | 9/2008 | Dobie et al. |
| 7,427,672 B2 | 9/2008 | Imanishi et al. |
| 7,491,805 B2 | 2/2009 | Vargeese et al. |
| 7,563,884 B2 | 7/2009 | Cowsert et al. |
| 7,576,067 B2 | 8/2009 | Weinbach et al. |
| 7,582,744 B2 | 9/2009 | Manoharan et al. |
| 7,723,509 B2 | 5/2010 | Manoharan et al. |
| 7,741,457 B2 | 6/2010 | Swayze et al. |
| 7,750,142 B2 | 7/2010 | Freier et al. |
| 7,851,615 B2 | 12/2010 | Manoharan et al. |
| 8,084,432 B2 | 12/2011 | Wedel et al. |
| 8,084,437 B2 | 12/2011 | Freier et al. |
| 8,093,222 B2 | 1/2012 | Freier et al. |
| 8,101,743 B2 | 1/2012 | Brown-Driver et al. |
| 8,106,022 B2 * | 1/2012 | Manoharan ............ C07H 21/02 514/43 |
| 8,137,695 B2 | 3/2012 | Rozema et al. |
| 8,143,230 B2 | 3/2012 | Bhanot et al. |
| 8,158,601 B2 | 4/2012 | Chen et al. |
| 8,313,772 B2 | 11/2012 | Rozema et al. |
| 8,344,125 B2 | 1/2013 | Manoharan et al. |
| 8,349,308 B2 | 1/2013 | Yurkovetskiy et al. |
| 8,404,862 B2 | 3/2013 | Manoharan et al. |
| 8,435,491 B2 | 5/2013 | Wang et al. |
| 8,450,467 B2 | 5/2013 | Rajeev et al. |
| 8,501,805 B2 | 8/2013 | Seth et al. |
| 8,501,930 B2 | 8/2013 | Rozema et al. |
| 8,530,640 B2 | 9/2013 | Seth et al. |
| 8,541,548 B2 | 9/2013 | Rozema |
| 8,546,556 B2 | 10/2013 | Seth et al. |
| 8,552,163 B2 | 10/2013 | Lee et al. |
| 8,648,186 B2 | 2/2014 | Monteleone |
| 8,653,047 B2 | 2/2014 | Crooke et al. |
| 8,664,190 B2 | 3/2014 | Freier et al. |
| 8,673,632 B2 | 3/2014 | Crooke et al. |
| 9,012,421 B2 | 4/2015 | Migawa et al. |
| 9,574,193 B2 | 2/2017 | Crooke et al. |
| 2003/0077829 A1 | 4/2003 | MacLachlan |
| 2003/0119724 A1 | 6/2003 | Ts'o et al. |
| 2004/0171570 A1 | 9/2004 | Allerson et al. |
| 2004/0242516 A1 | 12/2004 | Crooke et al. |
| 2005/0009088 A1 | 1/2005 | Crooke et al. |
| 2005/0130923 A1 | 6/2005 | Bhat et al. |
| 2005/0164235 A1 | 7/2005 | Manoharan |
| 2005/0244869 A1 | 11/2005 | Brown-Driver et al. |
| 2006/0148740 A1 | 7/2006 | Platenburg |
| 2006/0183886 A1 | 8/2006 | Tso et al. |
| 2007/0287831 A1 | 12/2007 | Seth et al. |
| 2008/0039618 A1 | 2/2008 | Allerson et al. |
| 2008/0108801 A1 | 5/2008 | Manoharan et al. |
| 2008/0206869 A1 | 8/2008 | Smith et al. |
| 2008/0281041 A1 | 11/2008 | Rozema et al. |
| 2008/0281044 A1 | 11/2008 | Monahan et al. |
| 2009/0203132 A1 | 8/2009 | Swayze et al. |
| 2009/0203135 A1 | 8/2009 | Forst et al. |
| 2009/0286973 A1 | 11/2009 | Manoharan et al. |
| 2009/0306180 A1 | 12/2009 | Bhanot et al. |
| 2010/0240730 A1 | 9/2010 | Beigelman et al. |
| 2010/0331390 A1 | 12/2010 | Crooke et al. |
| 2011/0097264 A1 | 4/2011 | Wang et al. |
| 2011/0097265 A1 | 4/2011 | Wang et al. |
| 2011/0105586 A1 | 5/2011 | Dobie et al. |
| 2011/0123520 A1 | 5/2011 | Manoharan et al. |
| 2011/0207799 A1 | 8/2011 | Rozema et al. |
| 2011/0269814 A1 | 11/2011 | Manoharan et al. |
| 2012/0035115 A1 | 2/2012 | Manoharan et al. |
| 2012/0071641 A1 | 3/2012 | Manoharan et al. |
| 2012/0095075 A1 | 4/2012 | Manoharan et al. |
| 2012/0101148 A1 | 4/2012 | Akinc et al. |
| 2012/0128760 A1 | 5/2012 | Manoharan et al. |
| 2012/0136042 A1 | 5/2012 | Rajeev et al. |
| 2012/0157509 A1 | 6/2012 | Hadwiger et al. |
| 2012/0165393 A1 | 6/2012 | Rozema et al. |
| 2012/0230938 A1 | 9/2012 | Rozema et al. |
| 2013/0004427 A1 | 1/2013 | El-Sayed et al. |
| 2013/0109817 A1 | 5/2013 | Yurkovetskiy et al. |
| 2013/0121954 A1 | 5/2013 | Wakefield et al. |
| 2013/0178512 A1 | 7/2013 | Manoharan et al. |
| 2013/0236968 A1 | 9/2013 | Rajeev et al. |
| 2013/0317085 A1 | 11/2013 | Graham et al. |

FOREIGN PATENT DOCUMENTS

| | | |
|---|---|---|
| WO | WO 1997/020563 | 6/1997 |
| WO | WO 1997/030731 | 8/1997 |
| WO | WO 1997/046098 | 12/1997 |
| WO | WO 1998/013381 | 4/1998 |
| WO | WO 2000/076554 | 12/2000 |
| WO | WO 2001/053528 | 7/2001 |
| WO | WO 2002/043771 | 6/2002 |
| WO | WO 2002/092772 | 11/2002 |
| WO | WO 2003/007913 | 1/2003 |
| WO | WO 2003/010284 | 2/2003 |
| WO | WO 2004/024757 | 3/2004 |
| WO | WO 2004/044181 | 5/2004 |
| WO | WO 2004/071407 | 8/2004 |
| WO | WO 2004/093783 | 11/2004 |
| WO | WO 2004/096016 | 11/2004 |
| WO | WO 2004/096996 | 11/2004 |
| WO | WO 2004/101619 | 11/2004 |
| WO | WO 2004/106356 | 12/2004 |
| WO | WO 2005/000201 | 1/2005 |
| WO | WO 2005/005599 | 1/2005 |
| WO | WO 2005/028628 | 3/2005 |
| WO | WO 2005/071080 | 8/2005 |
| WO | WO 2005/083124 | 9/2005 |
| WO | WO 2005/021570 | 10/2005 |
| WO | WO 2006/044531 | 4/2006 |
| WO | WO 2007/035759 | 3/2007 |
| WO | WO 2007/035771 | 3/2007 |
| WO | WO 2007/131237 | 11/2007 |
| WO | WO 2007/134014 | 11/2007 |
| WO | WO 2007/134181 | 11/2007 |
| WO | WO 2007/136988 | 11/2007 |
| WO | WO 2007/143317 | 12/2007 |
| WO | WO 2008/066776 | 6/2008 |
| WO | WO 2008/098788 | 8/2008 |
| WO | WO 2008/101157 | 8/2008 |
| WO | WO 2008/150729 | 12/2008 |
| WO | WO 2008/154401 | 12/2008 |
| WO | WO 2009/006478 | 1/2009 |
| WO | WO 2009/046141 | 4/2009 |
| WO | WO 2009/061851 | 5/2009 |
| WO | WO 2009/082607 | 7/2009 |

(56) References Cited

FOREIGN PATENT DOCUMENTS

| WO | WO 2009/126933 | 10/2009 |
|---|---|---|
| WO | WO 2009/134487 | 11/2009 |
| WO | WO 2009/148605 | 12/2009 |
| WO | WO 2010/017509 | 2/2010 |
| WO | WO 2010/045509 | 4/2010 |
| WO | WO 2010/054406 | 5/2010 |
| WO | WO 2010/088537 | 8/2010 |
| WO | WO 2010/121074 | 10/2010 |
| WO | WO 2010/129709 | 11/2010 |
| WO | WO 2010/144740 | 12/2010 |
| WO | WO 2010/148013 | 12/2010 |
| WO | WO 2011/038356 | 3/2011 |
| WO | WO 2011/047312 | 4/2011 |
| WO | WO 2011/085271 | 7/2011 |
| WO | WO 2011/100131 | 8/2011 |
| WO | WO 2011/120053 | 9/2011 |
| WO | WO 2011/139917 | 11/2011 |
| WO | WO 2011/163121 | 12/2011 |
| WO | WO 2012/037254 | 3/2012 |
| WO | WO 2012/068187 | 5/2012 |
| WO | WO 2012/083046 | 6/2012 |
| WO | WO 2012/083185 | 6/2012 |
| WO | WO 2012/089352 | 7/2012 |
| WO | WO 2012/089602 | 7/2012 |
| WO | WO 2012/135736 | 10/2012 |
| WO | WO 2012/142458 | 10/2012 |
| WO | WO 2012/145674 | 10/2012 |
| WO | WO 2012/145697 | 10/2012 |
| WO | WO 2012/149495 | 11/2012 |
| WO | WO 2012/174154 | 12/2012 |
| WO | WO 2012/177947 | 12/2012 |
| WO | WO 2013/033230 | 3/2013 |
| WO | WO 2013/043817 | 3/2013 |
| WO | WO 2013/063313 | 5/2013 |
| WO | WO 2013/075035 | 5/2013 |
| WO | WO 2013/119979 | 8/2013 |
| WO | WO 2013/142514 | 9/2013 |
| WO | WO 2013/165816 | 11/2013 |
| WO | WO 2013/166121 | 11/2013 |
| WO | WO 2013/177468 | 11/2013 |
| WO | WO 2014/025805 | 2/2014 |
| WO | WO 2014/179445 | 11/2014 |
| WO | WO 2014/205451 | 12/2014 |
| WO | WO 2015/006740 | 1/2015 |

OTHER PUBLICATIONS

Hilgard et al. Hepatology (2004), vol. 39, pp. 1398-1407.*
Abifadel "Mutations in PCSK9 cause autosomal dominant hypercholesterolemia" Nat Genet (2003) 34: 154-156.
Akamo et al., "Chemotherapy targeting regional lymph nodes by gastric submucosal injection of liposomal adriamycin inpatients with gastric carcinoma" Japanese J. Cancer Res. (1994) 85(6): 652-658.
Albaek et al., "Analogues of a Locked Nucleic Acid with Three-Carbon 2',4'-Linkages: Synthesis by Ring-Closing Metathesis and Influence on Nucleic Acid Duplex Stability and Structure" J. Org. Chem. (2006) 71: 7731-7740.
Bergeron "Subtilase-like pro-protein convertases: from molecular specificity to therapeutic applications" J Mol Endocrinol (2000) 24: 1-22.
Biessen et al., "Synthesis of Cluster Galactosides with High Affinity for the Hepatic Asialoglycoprotein Receptor" J. Med. Chem. (1995) 38: 1538-1546.
Biessen et al., "The Cholesterol Derivative of a Triantennary Galactoside with High Affinity for the Hepatic Asialoglycoprotein Receptor: a Potent Cholesterol Lowering Agent" J. Med. Chem. (1995) 38: 1846-1852.
Biessen et al., "Novel hepatotrophic prodrugs of the antiviral nucleoside 9-(2-phosphonylmethoxyethyl)adenine with improved pharmacokinetics and antiviral activity" FASEB J (2000) 14: 1784-1792.

Bligh et al., "A Rapid Method of Total Lipid Extraction and Purification" J Biochem Physiol (1959) 37: 911-917.
Braasch et al., "Novel Antisense and Peptide Nucleic Acid Strategies for Controlling Gene Expression" Biochemistry (2002) 41: 4503-4510.
Braasch et al., "Locked nucleic acid (LNA): fine-tuning the recognition of DNA and RNA" Chem. Biol. (2001) 8: 1-7.
Brubaker et al., "Structure-Function of the Glucagon Receptor Family of G Protein-Coupled Receptors: The Glucagon, GIP, GLP-1, and GLP-2 Receptors" Recept. Channels (2002) 8: 179-188.
Buur et al., "Penetration of 5-fluorouracil and prodrugs across the intestine of the albino rabbit: Evidence for shift in absorption site from the upper to the lower region of the gastrointestinal tract by prodrugs" J. Control Rel. (1990) 14(1): 43-53.
Connolly et al., "Binding and Endocytosis of Cluster Glycosides by Rabbit Hepatocytes" J. Biol. Chem. (1982) 257: 939-945.
Constantinides et al., "Formulation and Intestinal Absorption of Water-in-Oil Microemulsions Incorporating Medium-Chain Glycerides" Pharmaceutical Research (1994) 11: 1385.
Costa et al., "Amyloid fibril protein related to prealbumin in familial amyloidotic polyneuropathy" Proc Natl Acad Sci USA (1978) 75: 4499-4503.
Crew et al., "Eukaryotic initiation factor-4E in superficial and muscle invasive bladder cancer and its correlation with vascular endothelial growth factor expression and tumour progression" Br. J. Cancer (2000) 82: 161-166.
Crooke "Antisense Drug Technology, Principles, Strategies, and Applications" Edited by Stanley T. Crooke, 2008, Chapter 8, CRC Press, Boca Raton, Florida.
Crooke "Pharmacological Properties of 2'-O-Methoxyethyl Modified Oligonucleotides in Antisense a Drug Technology", Chapter 10, Crooke, S.T., ed., 2008.
Crooke "Toxicologic Properties in Antisense a Drug Technology", Chapter 12, pp. 342-351, Crooke, S.T., ed., 2008.
Davidson "Apolipoprotein B: mRNA Editing, Lipoprotein Assembly, and Presecretory Degradation" Annu. Rev. Nutr. (2000) 20: 169-193.
De Benedetti et al., "Overexpression of eukaryotic protein synthesis initiation factor 4E in HeLa cells results in aberrant growth and porphology" Proc. Natl. Acad. Sci. USA (1990) 87: 8212-8216.
Deli "Potential use of tight junction modulators to reversibly open membranous barriers and improve drug delivery" Biochimica et Biophysica Acta (2009) 1788: 892-910.
Dickson et al., "Rat Choroid Plexus Specializes in the Synthesis and the Secretion of Transthyretin (Prealbumin)" J Biol Chem (1986) 261: 3475-3478.
Dubuc "Statins Upregulate PCSK9, the Gene Encoding the Proprotein Convertase Neutral Apoptosis-Regulated Convertase-1 Implicated in Familial Hypercholesterolemia" Arterioscler Thromb Vasc Biol (2004) 24: 1454-1459.
Duff et al., "Intrabody Tissue-Specific Delivery of Antisense Conjugates in Aminals: Ligand-Linker-Antisense Oligomer Conjugates" Methods Enzymol (2000) 313: 297-321.
Elayadi et al., "Application of PNA and LNA oligomers to chemotherapy" Curr. Opinion Invens. Drugs (2001) 2: 558-561.
Elchebly et al., "Increased Insulin Sensitivity and Obesity Resistance in Mice Lakcing the Protein Tyrosine Phosphatase-1B Gene" Science (1999) 283:1544-1548.
El-Hariri et al., "The mitigating effects of phosphatidylcholines on bile salt- and lysophosphatidylcholine-induced membrane damage" J. Pharm. Pharmacol (1992) 44: 651.
Encio et al., "The Genomic Structure of the Human Glucocorticoid Receptor" J Biol Chem (1991) 266: 7182-7188.
Englisch et al., "Chemical Modified Oligonucleotides as Probes and Inhibitors" Angewandte Chemie, International Edition, 1991, 30: 613-329.
Freier et al., "The ups and downs of nucleic acid duplex stability: structure-stability studies on chemically-modified DNA:RNA duplexes" Nucleic Acids Research (1997) 25(22): 4429-4443.
Fried et al., "HBeAg and Hepatitis B Virus DNA as Outcome Predictors During Therapy with Peginterferon Alfa-2a for HBeAg-Positive Chronic Hepatitis B" Hepatology (2008) 47: 428.

(56) References Cited

OTHER PUBLICATIONS

Frieden et al., "Expanding the design horizon of antisense oligonucleotides with alpha-L-LNA" Nucleic Acids Research (2003) 21: 6365-6372.
Fukada et al., "Two Signals Are Necessary for Cell Proliferation Induced by a Cytokine Receptor gp130: Involvement of STAT3 in Anti-Apoptosis" Immunity (1996) 5: 449-460.
Ganem et al., "Hepatitis B virus infection—natural history and clinical consequences." N Engl J Med. (2004) 350; 1118-1129.
Gehring et al., "Assignment of the human gene for the glucocorticoid receptor to chromosome 5" Proc Natl Acad Sci USA (1985) 82: 3751-3755.
Gensberg "Subtilisin-related serine proteases in the mammalian constitutive secretory pathway" Semin Cell Dev. Biol (1998) 9: 11-17.
Giguere et al., "Functional Domains of the Human Glucocorticoid Receptor" Cell (1986) 46: 645-652.
Goldstein et al., "Tyrosine Dephosphorylation and Deactivation of Insulin Receptor Substrate-1 by Protein-tyrosine Phosphatase 1B" J Biol Chem (2000) 275: 4383-4389.
Gough et al., "Mitochondrial Stat3 Supports Ras-Dependent Oncogenic Transformation" Science (2009) 324: 1713-1716.
Graff et al., "Translational control and metastatic progression: Enhanced activity of the mRNA cap-binding protein eIF-4E selectively enhances translation of metastasis-related mRNAs" Clin. Exp. Metastasis (2003) 20: 265-273.
Graham et al., "Antisense Oligonucleotide Inhibition of Apolipoprotein C-III Reduces Plasma Triglycerides in Rodents, Nonhuman Primates, and Humans" Circulation Research (2013) 112: 1479-1515.
Hansen et al., "Glucagon Receptor mRNA Distribution in Rat Tussues" Peptides (1995) 16: 1163-1166.
Hardee et al., "Pharmacology, Target Reduction, and Drug Accumulation After Oral Feeding of an LNA Antisense Oligonucleotide Directed Against Apo-B 100" Arteriosclerosis, Thrombosis, and Vascular Biology, 2010 Scientific Sessions, Apr. 8-10, San Francisco, California, poster P358.
Haydon et al., "Progression of eIF4E Gene Amplification and Overexpression in Benign and Malignant Tumors of the Head and Neck" Cancer (2000) 88: 2803-2810.
Ho et al., "Preparation of Mucroemulsions Using Polyglycerol Fatty Acid Esters as Surfactant for the Delivery of Protein Drugs" Pharmaceutical Research (1996) 85: 138.
Hollenberg et al., "Primary structure and expression of a functional human glucocorticoid receptor cDNA" Nature (1985) 318: 635-641.
Horton "Combined analysis of oligonucleotide microarray data from transgenic and knockout mice identifies direct SREBP target genes" Proc Natl Acad Sci USA (2003) 100: 12027-12032.
Inoue et al., "Trial of electrolyzed strong acid aqueous solution lavage in the treatment of peritonitis and intraperitoneal abscess" Artif. Organs (1997) 21: 28-31.
International Search Report for application PCT/US15/34742 dated Aug. 26, 2015.
Jain et al., "Repression of Stat3 activity by activation of mitogen-activated protein kinase (MAPK)" Oncogene (1998) 17: 3157-3167.
Jarrett "Affinity chromatography with nucleic acid polymers" J Chromatogr. (1993) 618: 315-339.
Jayaprakash et al., "Non-Nucleoside Building Blocks for Copper-Assisted and Copper-Free Click Chemistry for the Efficient Synthesis of RNA Conjugates" Org Lett (2010) 12: 5410-5413.
Jervis et al., "New CD1d agonists: Synthesis and biological activity of 6"-triazole-substituted alpha-galactosyl ceramides" Bioorganic & Medicinal Chemistry Letters (2012) 22: 4348-4352.
Jiang et al., "Glucagon and regulation of glucose metabolism" J Physiol Endocrinol Metab (2003) 284: E671-E678.
Kaplan et al., "Regulation of the angiopoietin-like protein 3 gene by LXR" J Lipid Res (2003) 44: 136-143.
Kato et al., "N-acetylgalactosamine incorporation into a peptide containing consecutive threonine residues by UDP-N-acetyl-D-galactosaminide:polypeptide N-acetylgalactosaminyltransferases" Glycobiol (2001) 11: 821-829.

Kerekatte et al., "The Proto-Oncogene/Translation Factor eIF4E: a Survey of its Expression in Breast Carcinomas" Int. J. Cancer (1995) 64: 27-31.
Kim et al., "Oligomeric Glycopeptidomimetics Bearing the Cancer Related TN-Antigen" Tetrahedron Lett (1997) 38: 3487-3490.
Klaman et al., "Increased Energy Expenditure, Decrease Adiposity, and Tissue-Specific Insulin Sensitivity in Protein-Tyrosine Phosphatase 1B-Deficient Mice" Mol Cell Biol (2000) 20: 5479-5489.
Koishi et al., "Angptl3 regulates lipid metabolism in mice" Nature (2002): 151-157.
Kornilova et al., "Development of a fluorescence polarization binding assay for asialoglycoprotein receptor" Analyt Biochem (2012) 425: 43-46.
Koshkin et al., "LNA (Locked Nucleic Acids): Synthesis of the Adenine, Cytosine, Guanine, 5-Methylcytosine, Thymine and Uracil Bicyclonucleoside Monomers, Oligomerisation, and Unprecedented Nucleic Acid Recognition" Tetrahedron (1998) 54: 3607-3630.
Kroschwitz The Concise Encyclopedia of Polymer Science and Engineering, Kroschwitz, J.I., Ed., John Wiley & Sons, 1990, 858-859.
Kumar et al., "The First Analogues of LNA (Locked Nucleic Acids): Phosphorthioate-LNA and 2'-Thio-LNA" Bioorg. Med. Chem. Lett. (1998) 8: 2219-2222.
Lai et al. "Mucus-penetrating nanoparticles for drug and gene delivery to mucosal tissues" Adv. Drug Deilv. Rev. (2009) 61(2): 158-171.
Lazaris-Karatzas et al., "Malignant transformation by a eukaryotic initiation factor subunit that binds to mRNA 5' cap" Nature (1990) 345: 544-547.
Lee "Synthesis of some cluster glycosides for attachment to proteins or solid matrices" Carbohydr Res (1978) 67: 509-514.
Lee et al. "New and more efficient multivalent glyco-ligands for asialoglycoprotein receptor of mammalian hepatocytes" Bioorganic & Medicinal Chemistry (2011) 19: 2494-2500.
Lee et al. "Conjugation of low-molecular-weight heparin and deoxycholic acid for the development of a new oral anticoagulant agent" Circulation, Journal of the American Heart Association (2001) 104: 3116-3120.
Lee et al. "Mucosal Penetration Enhancers for Facilitation of Peptide and Protein Drug Absorption" Crit. Rev. Ther. Drug Carrier Systems (1991) 8: 91-92.
Lee et al., "New Synthetic Cluster Ligands for Galactose/N-Acetylgalactosamine-Specific Lectin of Mammalian Liver" Biochem. (1984) 23: 4255-4261.
Lee et al., "Facile Synthesis of a High-Affinity Ligand for Mammalian Hepatic Lectin Containing Three Terminal N-Acetylgalactosamine Residues" Bioconjug Chem. (1997) 8: 762-765.
Lee et al., "Protein microarrays to study carbohydrate-recognition events" Bioorg Med Chem Lett (2006) 16(19): 5132-5135.
Lee et al., "Preparation of Cluster Glycosides of N-Acetylgalactosamine That Have Subnanomolar Binding Constants Towards the Mammalian Hepatic Gal/GalNAc-specific Receptor" Glycoconjugate J (1987) 4: 317-328.
Lee et al., "Synthesis of Multivalent Neoglycoconjugates of MUC1 by the Conjugation of Carbohydrate-Centered, Triazole-Linked Glycoclusters to MUC1 Peptides Using Click Chemistry" J Org Chem (2012) 77: 7564-7571.
Lee et al., "Synthesis of Peptide-Based Trivalent Scaffold for Preparation of Cluster Glycosides" Methods Enzymol (2003) 362: 38-43.
Leren "Mutations in the PCSK9 gene in Norwegian subjects with autosomal dominant hypercholesterolemia" Clin Genet (2004) 65: 419-422.
Leumann "DNA Analogues: From Supramolecular Principles to Biological Properties" Bioord. & Med. Chem. (2002) 10:841-854.
Liang "Hepatitis B e antigen—the dangerous end game of hepatitis B." N Engl J Med. (2002) 347; 208-210.
Link "Pharmacological regulation of hepatic glucose production" Curr Opin Investig Drugs (2003) 4: 421-429.

(56) References Cited

OTHER PUBLICATIONS

Machida et al., "Bivalent Inhibitors for Disrupting Protein Surface-Substrate Interactions and for Dual Inhibition of Protein Prenyltransferases" J. Am. Chem. Soc. (2011) 133: 958-963.
Maier et al., "Synthesis of Antisense Oligonucleotides Conjugated to a Multivalent Carbohydrate Cluster for Cellular Targeting" Bioconjugate Chemistry (2003) 14: 18-29.
Maierhofer et al., "Probing multivalent carbohydrate-lectin interactions by an enzyme-linked lectin assay employing covalently immobilized carbohydrates" Bioorg Med Chem (2007) 15: 7661-7676.
Manoharan "Oligonucleotide Conjugates as Potential Antisense Drugs with Improved Uptake, Biodistribution, Targeted Delivery, and Mechanism of Action" Antisense Nucleic Acid Drug Dev (2002) 12:103-128.
Martin-Campos et al., "Identification of a novel mutation in the ANGPTL3 gene in two families diagnosed of familial hypobetalipoproteinemia without APOB mutation" Clin Chim Acta (2012) 413: 552-555.
Maxwell "Novel putative SREBP and LXR target genes identified by microarray analysis in liver of cholesterol-fed mice" J Lipid Res (2003) 44: 2109-2119.
Merwin et al., "Targeted Delivery of DNA Using YEE(GalNAcAH)3, a Synthetic Glycopeptide Ligand for the Asialoglycoprotein Receptor" Bioconjug Chem (1994) 5: 612-620.
Minicocci et al., "Mutations in the ANGPTL3 Gene and Familial Combined Hypolipidemia: A Clinical Biochemical Characterization" J Clin Endocrinol Metlab (2012) 97: e1266-1275.
Minicocci et al., "Clinical characteristics and plasma lipids in subjects with familial combined hypolipidemia: a pooled analysis" J of Lipid Research (2013) 54: 3481-3490.
Miyao et al. "Stability and pharmacokinetic characteristics of oligonucleotides modified at terminal linkages in mice" Antisense Res. Dev. (1995) 5: 115-121.
Moucari et al., "Early Serum HBsAg Drop: A Strong Predictor of Sustained Virological Response to Pegylated Interferon Alfa-2a in HBeAg-Negative Patients" Hepatology (2009) 49: 1151.
Musunuru et al., "Exome Sequencing, ANGPTL3 Mutations, and Familial Combined Hypolipidemia" N Engl J Med (2010) 363: 2220-2227.
Neel et al., "Protein tyrosine phosphatases in signal transduction" Curr Opin Cell Biol (1997) 9: 193-204.
Noto et al., "Prevalence of ANGPTL3 and APOB Gene Mutations in Subjects With Combined Hypolipidemia" Arterioscler Thromb Vasc Biol (2012) 32: 805-809.
Orum et al. "Locked nucleic acids: A promising molecular family for gene-function analysis and antisense drug development" Curr. Opinion Mol. Ther. (2001) 3: 239-243.
Palha "Transthyretin as a Thyroid Hormone Carrier: Function Revisited" Clin Chem Lab Med (2002) 40: 1292-1300.
Park et al., "The asialoglycoprotein receptor clears glycoconjugates terminating with sialic acidα2,6GalNAc" PNAS (2005) 102(47): 17125-17129.
Pavia et al., "Synthetic TN glycopeptide related to human glycophorin AM" Int J Pep Protein Res (1983) 22: 539-548.
Pennington et al., "Review article: artificial nutritional support for improved patient care" Ailment Pharmacol. Ther. (1995) 9: 471-481.
Pisciotta et al., "Characterization of Three Kindreds With Familial Combined Hypolipidemia Caused by Loaa-of-Function Mutations of ANGPTL3" Circulation Cardiovasc Genet (2012) 5: 42-50.
Pujol et al., "A Sulfur Tripod Glycoconjugate that Releases a High-Affinity Copper Chelator in Hepatocytes" Angew Chemie Int Ed Engl (2012) 51: 7445-7448.
Quesada et al., "Physiology of the pancreatic α-cell and glucagon secretion: role in glucose homeostasis and diabetes" J Endocrinol (2008) 199: 5-19.
Rajur et al., "Covalent Protein-Oligonucleotide Conjugates for Efficient Delivery of Antisense Molecules" Bioconjug Chem (1997) 8: 935-940.

Rensen et al., "Design and Synthesis of Novel N-Acetylgalactosamine-Terminated Glycolipids for Targeting of Lipoproteins to the Hepatic Asiaglycoprotein Receptor" J. Med. Chem. (2004) 47: 5798-5808.
Rensen et al., "Determination of the Upper Size Limit for Uptake and Processing of Ligands by the Asialoglycoprotein Receptor on Hepatocytes in Vitro and in Vivo" J. Biol. Chem. (2001) 276(40): 37577-37584.
Rensen et al., "Stimulation of Liver-Directed Cholesterol Flux in Mice by Novel N-Acetylgalactosamine-Terminated Glycolipids With High Affinity for the Asiaolglycoprotein Receptor" Arterioscler Thromb Vasc Biol (2006) 26: 169-175.
Robertson "Crohn's trial shows the pros of antisense" Nature Biotechnology (1997) 15: 209.
Romeo et al., "Rare loss-of-function mutations in ANGPTL family members contribute to plasma triglyceride levels in in humans" J Clin Invest (2009) 119(1): 70-79.
Rosenwald "Growth factor-independent expression of the gene encoding eukaryotic translation initiation factor 4E in transformed cell lines" Cancer Lett (1995) 98: 77-82.
Rosenwald et al., "Upregulation of protein synthesis initiation factor eIF-4E is an early event during colon carcinogenesis" Oncogene (1999) 18: 2507-2517.
Sakaki et al., "Human Transthyretin (Prealbumin) Gene and Molecular Genetics of Familial Amyloidotic Polyneuropathy." Mol Biol Med. (1989) 6:161-8.
Salama et al., "Tight junction modulation and its relationship to drug delivery" Advanced Drug Delivery Reviews (2006) 58: 15-28.
Salamat-Miller et al., "Current strategies used to enhance the paracellular transport of therapeutic polypeptides across the intestinal epithelium" International Journal of Pharmaceutics (2005) 294: 201-216.
Sanghvi and P.D. Cook Eds. ACS Symposium Series 580; Chapters 3 and 4, (pp. 40-65).
Sanghvi Chapter 15, Antisense Research and Applications, Crooke, S.T. and Lebleu, B., Eds., CRC Press, 1993, 273-288.
Saraiva et al., "Amyloid Fibril Protein in Familial Amyloidotic Polyneuropathy, Portuguese Type" J Clin Invest (1984) 74: 104-119.
Sato et al., "Glycoinsulins: Dendritic Sialyloligosaccharide-Displaying Insulins Showing a Prolonged Blood-Sugar-Lowering Activity" J Am Chem Soc (2004) 126: 14013-14022.
Seeger et al., "Hepatitis B virus biology." Microbiol Mol Biol Rev. (2000) 64; 51-68.
Seidah "Proprotein and prohormone convertases: a family of subtilases generating diverse bioactive polypeptides" Brain Res. (1999) 848: 45-62.
Shioji "Tgenetic variants in PCSK9 affect the cholesterol level in Japanese" J Hum Genet (2004) 49: 109-114.
Sindelka et al., "Association of Obesity, Diabetes, Serum Lipids and Blood Pressure Regulates Insulin Action" Physiol Res (2002) 51: 85-91.
Singh et al., "LNA (locked nucleic acids): synthesis and high-affinity nucleic acid recognition" Chem. Commun. (1998) 4: 455-456.
Singh et al., "Synthesis of 2'-Amino-LNA: A Novel Conformationally Restricted High-Affinity Oligonucleotide Analogue with a Handle" J. Org. Chem. (1998) 63: 10035-10039.
Sliedregt et al., "Design and Synthesis of Novel Amphiphilic Dendritic Galactosides for Selective Targeting of Liposomes to the Hepatic Asialoglycoprotein Receptor" J. Med. Chem. (1999) 42: 609-618.
Somogyi et al., "Evaluation of the intestinal absorption of erythromycin in man: absolute bioavailability and comparison with enteric coated erythromycin" Pharm. Res. (1995) 12: 149-154.
Sousa et al., "Neurodegeneration in familial amyloid polyneuropathy: from pathology to molecular signaling" Prog Neurobiol (2003) 71: 385-400.
Srivastava et al., "Five- and Six-Membered Conformationally Locked 2',4'-Carbocyclic ribo-Thymidines: Synthesis, Structure, and Biochemical Studies" J. Am. Chem. Soc. (2007) 129(26): 8362-8379.
Takahashi et al., "The use of a perfluorochemical emulsion as a vascular perfusate in drug absorption" J. Pharm. Phamacol (1988) 40: 252-257.

(56) References Cited

OTHER PUBLICATIONS

Takakura et al., "Uptake characteristics of oligonucleotides in the isolated rat liver perfusion system" Antisense & Nucl. Acid Drug Dev. (1996) 6: 177-183.
Tanskanen et al., "Senile systemic amyloidosis affects 25% of the very aged and associates with genetic variation in alpha2-macroglobulin and tau: A population-based autopsy study" Ann Med (2008) 40(3): 232-239.
Taylor "Curbing activation: proprotein convertases in homeostasis and pathology" FASEB (2003) 17: 1215-1227.
Timms et al., "A mutation in PCSK9 causing autosomal-dominant hypercholesterolemia in a Utah pedigree" Hum Genet (2004) 114: 349-353.
Tomiya et al., "Liver-targeting of primaquine-(poly-γ-glutamic acid) and its degradation in rat hepatocytes" Bioorg Med Chem (2013) 21: 5275-5281.
Toyokuni et al., "Synthetic Vaccines: I. Synthesis of Multivalent Tn Antigen Cluster-Lysyllysine Conjugates" Tetrahedron Lett (1990) 31: 2673-2676.
Trappeniers et al., 6'-Derivatised alpha-GalCer Analogues Capable of Inducing Strong CD1d-Mediated Th1-Biased NKT Cell Responses in Mice (2008) 130: 16468-16469.
Valdivielso et al., "Association of moderate and severe hypertriglyceridemia with obesity, diabetes mellitus and vascular disease in the Spanish working population: Results of the ICARIA study" Atherosclerosis (2009) 207: 573-578.
Valentijn et al., "Solid-phase synthesis of lysine-based cluster galactosides with high affinity for the Asialoglycoprotein Receptor" Tetrahedron (1997) 53(2): 759-770.
Van Rossenberg et al., "Stable polyplexes based on arginine-containing oligopeptides for in vivo gene delivery" Gene Ther (2004) 11: 457-464.
Wahlestedt et al., "Potent and nontoxic antisense oligonucleotides containing locked nucleic acids" Proc. Natl. Acad. Sci. U.S.A. (2000) 97: 5633-5638.
Wang et al., "Expression of the Eukaryotic Translation Initiation Factors 4E and 2α in Non-Hodgkin's Lymphomas" Am. J. Pathol. (1999) 155: 247-255.
Weinberger et al., "Identification of Human Glucocorticoid Receptor Complementary DNA Clones by Epitope Selection" Science (1985) 228: 740-742.
Westerlind et al., "Ligands of the asialoglycoprotein receptor for targeted gene delivery, part 1: Synthesis of and binding studies with biotinylated cluster glycosides containing N-acetylgalactosamine" Glycoconj J (2004) 21: 227-241.
Whitehead et al., "Safe and effective permeation enhancers for oral drug delivery" Pharmaceutical Research (2008) 25(8): 1782-1788.
Willer et al., "Newly identified loci that influence lipid concentrations and risk of coronary artery disease" Nature Genetics (2008) 40(2): 161-169.
Yamamoto et al., "A mechanistic study on enhancement of rectal permeability to insulin in the albino rabbit" J. Pharm. Exp. Ther. (1992) 263: 25-31.
Yamashita et al., "Effects of diclofenac sodium and disodium ethylenediaminetetraacetate on electrical parameters of the mucosal membrane and their relation to the permeability enhancing effects in the rat jejunum" J. Pharm. Pharmacol. (1987) 39: 621-626.
Yamashita et al., "Effect of adjuvants on charge-selective permeability and electrical resistance of rat jejunal membrane" J. Pharm. Sci. (1990) 79: 579-583.
Zhang et al., "Spontaneous Atherosclerosis in Aged Lipoprotein Lipase-Deficient Mice With Severe Hypertriglyceridemia on a Normal Chow Diet" Circ Res (2008) 102(2): 250-256.
Zhong et al., "Stat3 and Stat4: Members of the family of signal transducers and activators of transcription" Proc Natl Acad Sci USA (1994) 91: 4806-4810.
Zhou "Proteolytic Processing in the Secretory Pathway" J Biol Chem (1999) 274: 20745-20748.
Zhou et al., "Fine Tuning of Electrostatics around the Internucleotidic Phosphate through Incorporation of Modified 2',4'-Carbocyclic-LNAs and -ENAs Leads to Significant Modulation of Antisense Properties" J. Org. Chem. (2009) 74: 118-134.
Bock et al., "Glycosylation Reactions With Di-O-Acetyl-2,6-Dibromo-2,6-Dideoxy-Alpha-D-Mannopyranosyl Bromide: A Simple Synthesis of Methyl 2,6-Dideoxy-Darabino-Hexopyranoside" Acta Chemica Scandinavica (1998) B42: 640-645.
Branda et al., "Amplification of antibody production by phosphorothioate oligonucleotides" J Lab Clin Med (1996) 128(3): 329-339.
Geary et al., "Effect of Dose and Plasma Concentration on Liver Uptake and Pharmacologic Activity of a 2'-Methoxyethyl Modified Chimeric Antisense Oligonucleotide Targeting PTEN." Biochem. Pharmacol. (2009) 78(3): 284-291.
Geary, "Pharmacokinetic Properties of 2'-O-(2-Methoxyethyl)-Modified Oligonucleotide Analogs in Rats" Journal of Pharmacology and Experimental Therapeutics (2001) 296(3): 890-897.
Khorev et al., "Trivalent, Gal/GalNAc-containing ligands designed for the asialoglycoprotein receptor" Bioorganic and Medicinal Chemistry (2008) 16(9): 5216-5231.
Koller et al., "Mechanisms of single-stranded phosphorothioate modified antisense oligonucleotide accumulation in heptocytes." Nucleic Acids Res. (2011) 39(11): 4795-4807.
Winkler et al., "Oligonucleotide conjugates for therapeutic applications" Therapeutic Delivery (2013) 4(7): 791-809.
International Search Report for application PCT/US15/032045 dated May 21, 2015.
Extended European Search Report for 15803337.3 dated Jan. 25, 2018.

\* cited by examiner

CONJUGATED ANTISENSE COMPOUNDS AND THEIR USE

SEQUENCE LISTING

The present application is being filed along with a Sequence Listing in electronic format. The Sequence Listing is provided as a file entitled CORE0126USASEQ_ST25.txt, created on Oct. 13, 2016, which is 688 Kb in size. The information in the electronic format of the sequence listing is incorporated herein by reference in its entirety.

BACKGROUND OF THE INVENTION

The principle behind antisense technology is that an antisense compound hybridizes to a target nucleic acid and modulates the amount, activity, and/or function of the target nucleic acid. For example in certain instances, antisense compounds result in altered transcription or translation of a target. Such modulation of expression can be achieved by, for example, target mRNA degradation or occupancy-based inhibition. An example of modulation of RNA target function by degradation is RNase H-based degradation of the target RNA upon hybridization with a DNA-like antisense compound. Another example of modulation of gene expression by target degradation is RNA interference (RNAi). RNAi refers to antisense-mediated gene silencing through a mechanism that utilizes the RNA-induced silencing complex (RISC). An additional example of modulation of RNA target function is by an occupancy-based mechanism such as is employed naturally by microRNA. MicroRNAs are small non-coding RNAs that regulate the expression of protein-coding RNAs. The binding of an antisense compound to a microRNA prevents that microRNA from binding to its messenger RNA targets, and thus interferes with the function of the microRNA. MicroRNA mimics can enhance native microRNA function. Certain antisense compounds alter splicing of pre-mRNA. Regardless of the specific mechanism, sequence-specificity makes antisense compounds attractive as tools for target validation and gene functionalization, as well as therapeutics to selectively modulate the expression of genes involved in the pathogenesis of diseases.

Antisense technology is an effective means for modulating the expression of one or more specific gene products and can therefore prove to be uniquely useful in a number of therapeutic, diagnostic, and research applications. Chemically modified nucleosides may be incorporated into antisense compounds to enhance one or more properties, such as nuclease resistance, pharmacokinetics or affinity for a target nucleic acid. In 1998, the antisense compound, Vitravene® (fomivirsen; developed by Isis Pharmaceuticals Inc., Carlsbad, Calif.) was the first antisense drug to achieve marketing clearance from the U.S. Food and Drug Administration (FDA), and is currently a treatment of cytomegalovirus (CMV)-induced retinitis in AIDS patients. For another example, an antisense oligonucleotide targeting ApoB, KYNAMRO™, has been approved by the U.S. Food and Drug Administration (FDA) as an adjunct treatment to lipid-lowering medications and diet to reduce low density lipoprotein-cholesterol (LDL-C), ApoB, total cholesterol (TC), and non-high density lipoprotein-cholesterol (non HDL-C) in patients with homozygous familial hypercholesterolemia (HoFH).

New chemical modifications have improved the potency and efficacy of antisense compounds, uncovering the potential for oral delivery as well as enhancing subcutaneous administration, decreasing potential for side effects, and leading to improvements in patient convenience. Chemical modifications increasing potency of antisense compounds allow administration of lower doses, which reduces the potential for toxicity, as well as decreasing overall cost of therapy. Modifications increasing the resistance to degradation result in slower clearance from the body, allowing for less frequent dosing. Different types of chemical modifications can be combined in one compound to further optimize the compound's efficacy.

SUMMARY OF THE INVENTION

In certain embodiments, the present disclosure provides conjugated antisense compounds. In certain embodiments, the present disclosure provides conjugated antisense compounds comprising an antisense oligonucleotide complementary to a nucleic acid transcript. In certain embodiments, the present disclosure provides methods comprising contacting a cell with a conjugated antisense compound comprising an antisense oligonucleotide complementary to a nucleic acid transcript. In certain embodiments, the present disclosure provides methods comprising contacting a cell with a conjugated antisense compound comprising an antisense oligonucleotide and reducing the amount or activity of a nucleic acid transcript in a cell.

The asialoglycoprotein receptor (ASGP-R) has been described previously. See e.g., Park et al., PNAS vol. 102, No. 47, pp 17125-17129 (2005). Such receptors are expressed on liver cells, particularly hepatocytes. Further, it has been shown that compounds comprising clusters of three N-acetylgalactosamine (GalNAc) ligands are capable of binding to the ASGP-R, resulting in uptake of the compound into the cell. See e.g., Khorev et al., Bioorganic and Medicinal Chemistry, 16, 9, pp 5216-5231 (May 2008). Accordingly, conjugates comprising such GalNAc clusters have been used to facilitate uptake of certain compounds into liver cells, specifically hepatocytes. For example it has been shown that certain GalNAc-containing conjugates increase activity of duplex siRNA compounds in liver cells in vivo. In such instances, the GalNAc-containing conjugate is typically attached to the sense strand of the siRNA duplex. Since the sense strand is discarded before the antisense strand ultimately hybridizes with the target nucleic acid, there is little concern that the conjugate will interfere with activity. Typically, the conjugate is attached to the 3' end of the sense strand of the siRNA. See e.g., U.S. Pat. No. 8,106,022. Certain conjugate groups described herein are more active and/or easier to synthesize than conjugate groups previously described.

In certain embodiments of the present invention, conjugates are attached to single-stranded antisense compounds, including, but not limited to RNase H based antisense compounds and antisense compounds that alter splicing of a pre-mRNA target nucleic acid. In such embodiments, the conjugate should remain attached to the antisense compound long enough to provide benefit (improved uptake into cells) but then should either be cleaved, or otherwise not interfere with the subsequent steps necessary for activity, such as hybridization to a target nucleic acid and interaction with RNase H or enzymes associated with splicing or splice modulation. This balance of properties is more important in the setting of single-stranded antisense compounds than in siRNA compounds, where the conjugate may simply be attached to the sense strand. Disclosed herein are conjugated single-stranded antisense compounds having improved potency in liver cells in vivo compared with the same antisense compound lacking the conjugate. Given the required balance of properties for these compounds such improved potency is surprising.

In certain embodiments, conjugate groups herein comprise a cleavable moiety. As noted, without wishing to be bound by mechanism, it is logical that the conjugate should remain on the compound long enough to provide enhancement in uptake, but after that, it is desirable for some portion or, ideally, all of the conjugate to be cleaved, releasing the parent compound (e.g., antisense compound) in its most active form. In certain embodiments, the cleavable moiety is a cleavable nucleoside. Such embodiments take advantage of endogenous nucleases in the cell by attaching the rest of the conjugate (the cluster) to the antisense oligonucleotide through a nucleoside via one or more cleavable bonds, such as those of a phosphodiester linkage. In certain embodiments, the cluster is bound to the cleavable nucleoside through a phosphodiester linkage. In certain embodiments, the cleavable nucleoside is attached to the antisense oligonucleotide (antisense compound) by a phosphodiester linkage. In certain embodiments, the conjugate group may comprise two or three cleavable nucleosides. In such embodiments, such cleavable nucleosides are linked to one another, to the antisense compound and/or to the cluster via cleavable bonds (such as those of a phosphodiester linkage). Certain conjugates herein do not comprise a cleavable nucleoside and instead comprise a cleavable bond. It is shown that that sufficient cleavage of the conjugate from the oligonucleotide is provided by at least one bond that is vulnerable to cleavage in the cell (a cleavable bond).

In certain embodiments, conjugated antisense compounds are prodrugs. Such prodrugs are administered to an animal and are ultimately metabolized to a more active form. For example, conjugated antisense compounds are cleaved to remove all or part of the conjugate resulting in the active (or more active) form of the antisense compound lacking all or some of the conjugate.

In certain embodiments, the conjugates herein do not substantially alter certain measures of tolerability. For example, it is shown herein that conjugated antisense compounds are not more immunogenic than unconjugated parent compounds. Since potency is improved, embodiments in which tolerability remains the same (or indeed even if tolerability worsens only slightly compared to the gains in potency) have improved properties for therapy.

In certain embodiments, the conjugates herein comprise one or more modifications to the galactosyl analgues with substitutions at the anomeric, C2-, C5-, and/or C6-positions. In certain embodiments, the oxygen or hydroxyl moiety at one or more of the anomeric, C2-, C5-, and/or C6-positions is replaced with a sulfur. In certain embodiments, modification to the galactosyl analgues with substitutions at the anomeric, C2-, C5-, and/or C6-positions provides an increase in potency, efficacy, an/or or stability. In certain embodiments, modification to the galactosyl analgues with substitutions at the anomeric, C2-, C5-, and/or C6-positions provides an increase in potency, efficacy, an/or or stability when compared to an unmodified galactosyl conjugate. For example, in certain embodiments, it's desirable to reduce the molecular weight of a conjugate. In certain embodiments, conjugates having only one unmodified galactosyl or only one unmodified N-acetylgalactosamine may provide an increase in potency, but the increase in potency would be less than a conjugate with three unmodified N-acetylgalactosamines. Certain modified galactosyl analogue conjugatess provided herein have increased potency compared to unmodified N-acetylgalactosamine conjugate. For example, compounds having one modified galactosyl analogue conjugate provide a greater increase in potency compared to compounds having one unmodified N-acetylgalactosamine conjugate. In certain embodiments, modified galactosyl analogues provided herein have greater stability than unmodified N-acetylgalactosamine conjugates. In certain embodiments, modified galactosyl analogue conjugates provided herein have greater affinity for the ASGP-R receptor compared to unmodified N-acetylgalactosamine conjugates.

In certain embodiments, conjugation of antisense compounds herein results in increased delivery, uptake and activity in hepatocytes. Thus, more compound is delivered to liver tissue.

In certain embodiments, a compound has a structure selected from among the following:

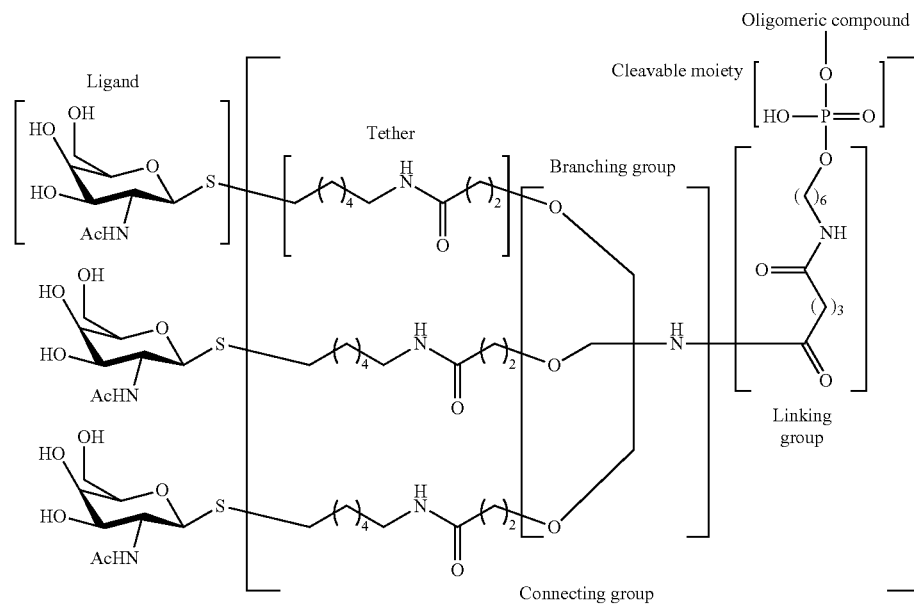

The present disclosure provides the following non-limiting numbered embodiments:

Embodiment 1

A compound comprising an oligomer and a conjugate group, wherein the conjugate group comprises a moiety having Formula I:

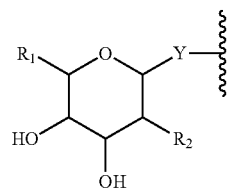

I wherein:
$R_1$ is selected from $Q_1$, $CH_2Q_1$, $CH_2OH$, $CH_2NJ_1J_2$, $CH_2N_3$ and $CH_2SJ_3$;
$Q_1$ is selected from aryl, substituted aryl, heterocyclic, substituted heterocyclic, heteroaryl and substituted heteroaryl;
$R_2$ is selected from $Q_4$, $N_3$, CN, halogen, N(H)C(=O)-$Q_2$, substituted thiol, aryl, substituted aryl, heterocyclic, substituted heterocyclic, heteroaryl and substituted heteroaryl;
$Q_2$ is selected from H, $C_1$-$C_6$ alkyl, substituted $C_1$-$C_6$ alkyl, $C_1$-$C_6$ alkoxy, substituted $C_1$-$C_6$ alkoxy, aryl, substituted aryl, heterocyclic, substituted heterocyclic, heteroaryl and substituted heteroaryl;
Y is selected from O, S, $CJ_4J_5$, $NJ_6$ and $N(J_6)C(=O)$;
$J_1$, $J_2$, $J_3$, $J_4$, $J_5$, and $J_6$ are each, independently, H or a substituent group;
each substituent group is, independently, mono or poly substituted with optionally protected substituent groups independently selected from halogen, $C_1$-$C_6$ alkyl, $C_1$-$C_6$ alkoxy, aryl, heterocyclic and heteroaryl wherein each substituent group can include a linear or branched alkylene group optionally including one or more groups independently selected from O, S, NH and C(=O), and wherein each substituent group may be further substituted with one or more groups independently selected from $C_1$-$C_6$ alkyl, halogen or $C_1$-$C_6$ alkoxy wherein each cyclic group is mono or polycyclic; and
when Y is O and $R_1$ is $CH_2OH$ then $R_2$ is other than OH, $NH_2$, and $N(H)C(=O)CH_3$.

Embodiment 2

The compound of embodiment 1 wherein the moiety having Formula I is linked to the oligomer through a connecting group.

Embodiment 3

The compound of embodiment 1 or 2 having Formula II:

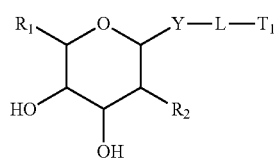

II wherein:
$R_1$ is selected from $Q_1$, $CH_2Q_1$, $CH_2OH$, $CH_2NJ_1J_2$, $CH_2N_3$ and $CH_2SJ_3$;
$Q_1$ is selected from aryl, substituted aryl, heterocyclic, substituted heterocyclic, heteroaryl and substituted heteroaryl;
$R_2$ is selected from $Q_4$, $N_3$, CN, halogen, N(H)C(=O)-$Q_2$, substituted thiol, aryl, substituted aryl, heterocyclic, substituted heterocyclic, heteroaryl and substituted heteroaryl;
$Q_2$ is selected from H, $C_1$-$C_6$ alkyl, substituted $C_1$-$C_6$ alkyl, $C_1$-$C_6$ alkoxy, substituted $C_1$-$C_6$ alkoxy, aryl, substituted aryl, heterocyclic, substituted heterocyclic, heteroaryl and substituted heteroaryl;
Y is selected from O, S, $CJ_4J_5$, $NJ_6$ and $N(J_6)C(=O)$;
L is a connecting group;
$J_1$, $J_2$, $J_3$, $J_4$, $J_5$ and $J_6$ are each, independently, H or a substituent group;
$T_1$ is said oligomer; and
each substituent group is, independently, mono or poly substituted with optionally protected substituent groups independently selected from halogen, $C_1$-$C_6$ alkyl, $C_1$-$C_6$ alkoxy, aryl, heterocyclic and heteroaryl wherein each substituent group can include a linear or branched alkylene group optionally including one or more groups independently selected from O, S, NH and C(=O), and wherein each substituent group may be further substituted with one or more groups independently selected from $C_1$-$C_6$ alkyl, halogen or $C_1$-$C_6$ alkoxy wherein each cyclic group is mono or polycyclic.

Embodiment 4

The compound of embodiment 3 having Formula II:

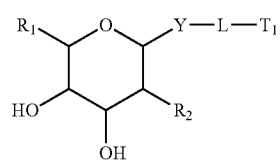

II wherein:
$R_1$ is selected from $Q_1$, $CH_2Q_1$, $CH_2OH$, $CH_2NJ_1J_2$, $CH_2N_3$ and $CH_2SJ_3$;
$Q_1$ is selected from aryl, substituted aryl, heterocyclic, substituted heterocyclic, heteroaryl and substituted heteroaryl;
$R_2$ is selected from $Q_4$, $N_3$, CN, halogen, N(H)C(=O)-$Q_2$, substituted thiol, aryl, substituted aryl, heterocyclic, substituted heterocyclic, heteroaryl and substituted heteroaryl;
$Q_2$ is selected from H, $C_1$-$C_6$ alkyl, substituted $C_1$-$C_6$ alkyl, $C_1$-$C_6$ alkoxy, substituted $C_1$-$C_6$ alkoxy, aryl, substituted aryl, heterocyclic, substituted heterocyclic, heteroaryl and substituted heteroaryl;
Y is selected from O, S, $CJ_4J_5$, $NJ_6$ and $N(J_6)C(=O)$;
L is a connecting group comprising a linear alkylene group optionally including one or more groups independently selected from O, S, $NJ_7$, C(=O), a phosphorus linking group and a cleavable bond or L is a single bond between Y and $T_1$;
$J_1$, $J_2$, $J_3$, $J_4$, $J_5$, $J_6$ and $J_7$ are each, independently, H or a substituent group;

$T_1$ is said oligomer; and each substituent group is, independently, mono or poly substituted with optionally protected substituent groups independently selected from halogen, $C_1$-$C_6$ alkyl, $C_1$-$C_6$ alkoxy, aryl, heterocyclic and heteroaryl wherein each substituent group can include a linear or branched alkylene group optionally including one or more groups independently selected from O, S, NH and C(=O), and wherein each substituent group may be further substituted with one or more groups independently selected from $C_1$-$C_6$ alkyl, halogen or $C_1$-$C_6$ alkoxy wherein each cyclic group is mono or polycyclic.

Embodiment 5

The compound of any of embodiments 1 to 4 wherein $R_1$ is selected from $Q_1$ and $CH_2Q_1$.

Embodiment 6

The compound of any of embodiments 1 to 5 wherein $Q_1$ is substituted heteroaryl.

Embodiment 7

The compound of embodiment 6 wherein $Q_1$ is selected from among:

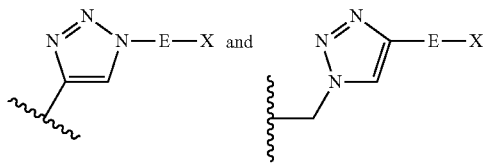

wherein:
E is a single bond or one of said linear or branched alkylene groups; and
X is H or one of said substituent groups.

Embodiment 8

The compound of embodiment 7 wherein X is selected from substituted aryl and substituted heteroaryl.

Embodiment 9

The compound of embodiment 8 wherein X is phenyl or substituted phenyl comprising one or more substituent groups selected from F, Cl, Br, $CO_2Et$, $OCH_3$, CN, $CH_3$, $OCH_3$, $CF_3$, $N(CH_3)_2$ and O-phenyl.

Embodiment 10

The compound of embodiment 7 wherein $Q_1$ has the formula:

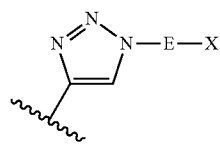

wherein:
-E-X is selected from among:

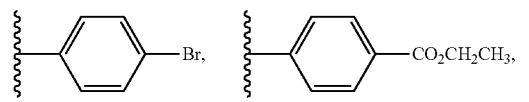

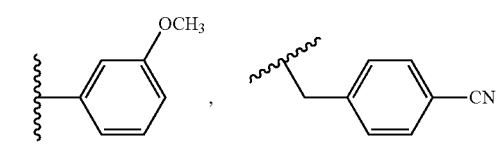

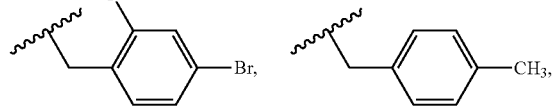

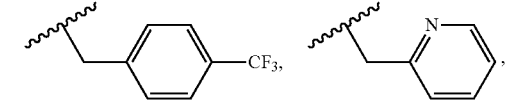

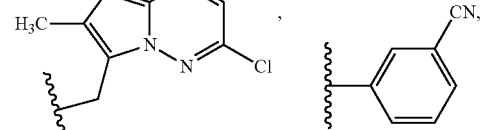

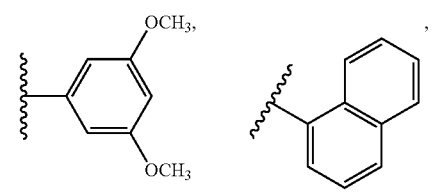

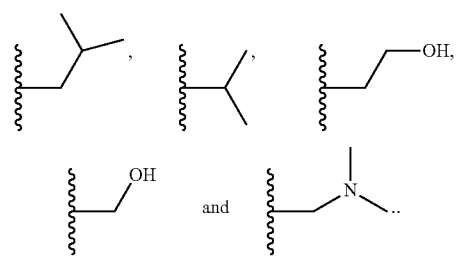

Embodiment 11

The compound of embodiment 7 wherein $Q_1$ has the formula:

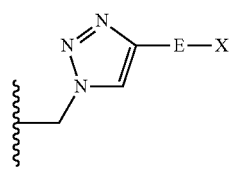

wherein:
-E-X is selected from among:

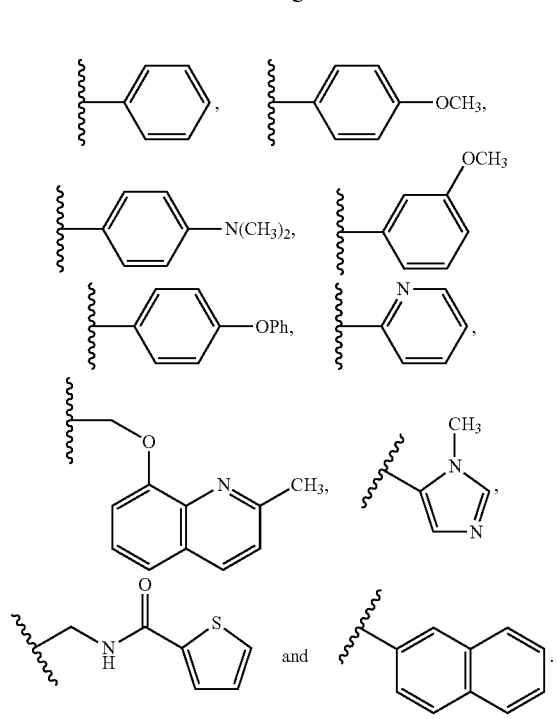

Embodiment 12

The compound of any of embodiments 1 to 4 wherein $R_1$ is selected from $CH_2OH$, $CH_2NJ_1J_2$, $CH_2N_3$ and $CH_2SJ_3$ wherein $J_1$, $J_2$ and $J_3$ are each independently selected from H and $CH_3$.

Embodiment 13

The compound of embodiment 12 wherein $J_1$, $J_2$ and $J_3$ are each H.

Embodiment 14

The compound of embodiment 12 wherein $J_1$, $J_2$ and $J_3$ are each $CH_3$.

Embodiment 15

The compound of any of embodiments 1 to 5 wherein $Q_1$ is selected from:

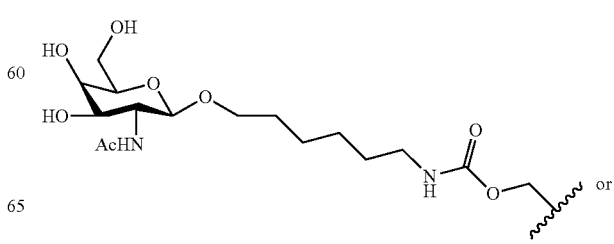

or —$CH_2NH_2$.

Embodiment 16

The compound of embodiment 15, wherein $Q_3$ is selected from among:

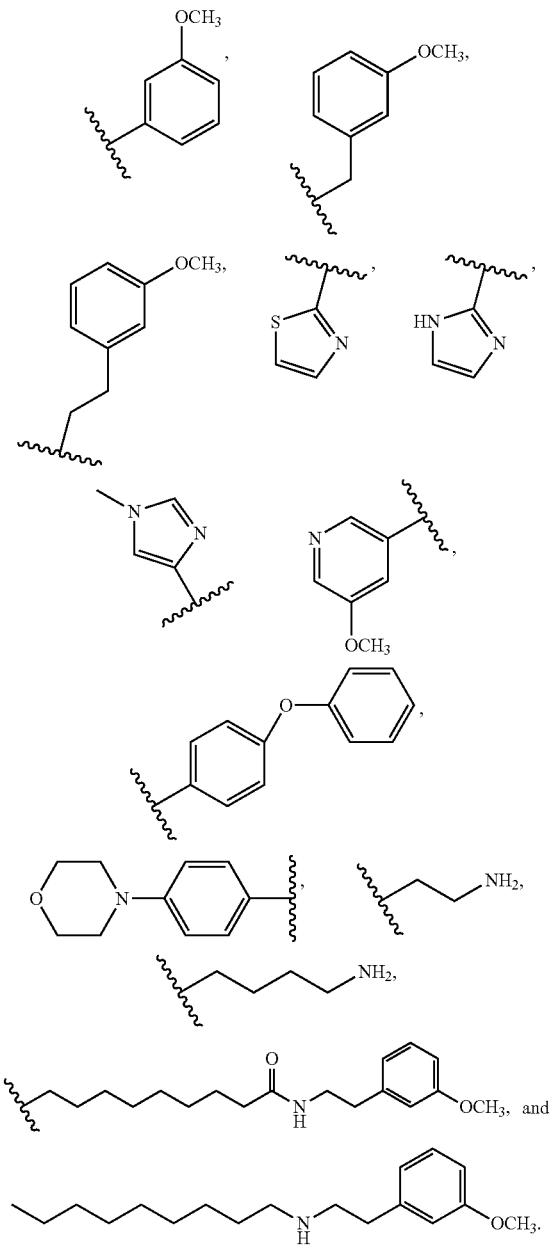

Embodiment 17

The compound of any of embodiments 1 to 5 wherein $Q_1$ is selected from:

-continued

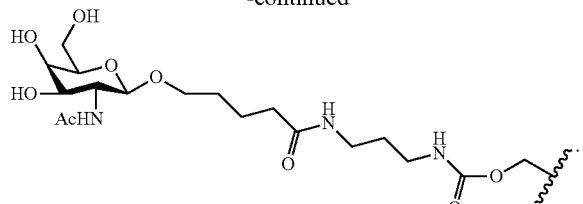

Embodiment 18

The compound of any of embodiments 1 to 17 wherein $R_2$ is N(H)C(=O)-$Q_2$.

Embodiment 19

The compound of embodiment 18 wherein $Q_2$ is selected from $C_1$-$C_6$ alkyl, substituted $C_1$-$C_6$ alkyl, $C_1$-$C_6$ alkoxy and substituted $C_1$-$C_6$ alkoxy.

Embodiment 20

The compound of embodiment 19 wherein $Q_2$ is selected from $CH_3$, $CH_2CH_3$, $CH(CH_3)_2$, $(CH_2)_2CH_3$, $C(CH_3)_3$, $CCl_3$, $CF_3$, O—$C(CH_3)_3$, $CH_2CO_2H$, $CH_2NH_2$ and $CH_2CF_3$.

Embodiment 21

The compound of any of embodiments 1 to 20 wherein $Q_2$ is selected from aryl, substituted aryl, heterocyclic, substituted heterocyclic, heteroaryl and substituted heteroaryl.

Embodiment 22

The compound of embodiment 21 wherein $Q_2$ is selected from aryl, substituted aryl, heteroaryl and substituted heteroaryl.

Embodiment 23

The compound of embodiment 22 wherein $Q_2$ is selected is selected from among:

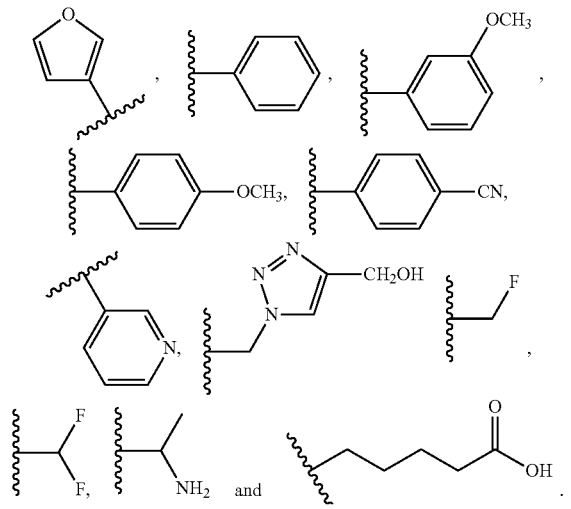

Embodiment 24

The compound of any of embodiments 1 to 14 wherein $R_2$ is selected from aryl, substituted aryl, heterocyclic, substituted heterocyclic, heteroaryl and substituted heteroaryl.

Embodiment 25

The compound of any of embodiments 1 to 17 wherein $R_2$ is $Q_4$.

Embodiment 26

The compound of any of embodiments 1 to 17 or 25, wherein $Q_4$ is selected from among:

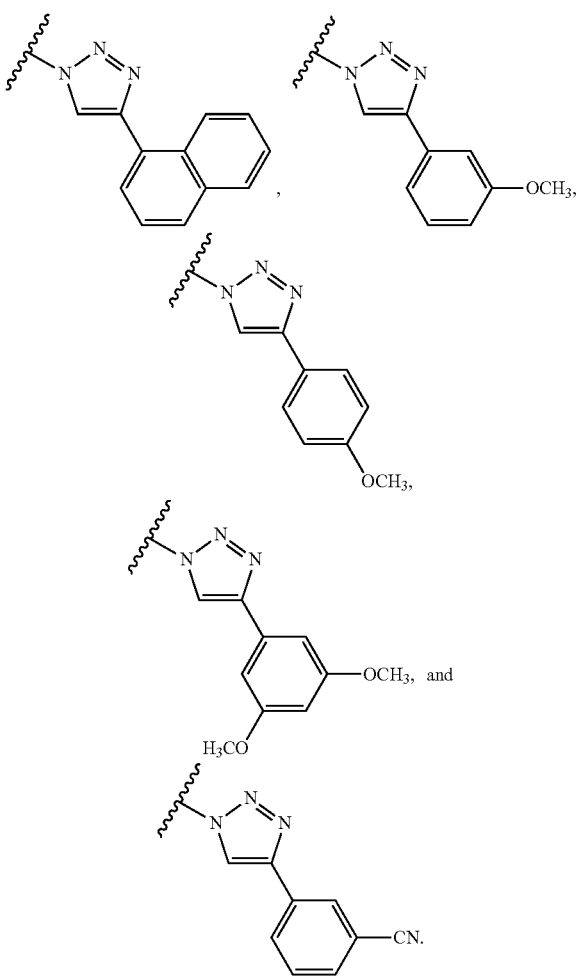

Embodiment 27

The compound of embodiment 24 wherein $R_2$ has the formula:

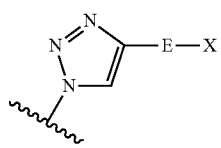

wherein:
E is a single bond or one of said linear or branched alkylene groups; and
X is H or one of said substituent groups.

Embodiment 28

The compound of embodiment 27 wherein -E-X is selected from $CH_2OH$, $CH_2NH_2$, $CH_2N(H)CH_3$, $CH_2N(CH_3)_2$, $CO_2H$ and $CH_2NHCOCH_3$.

Embodiment 29

The compound of embodiment 28 wherein -E-X is selected from among:

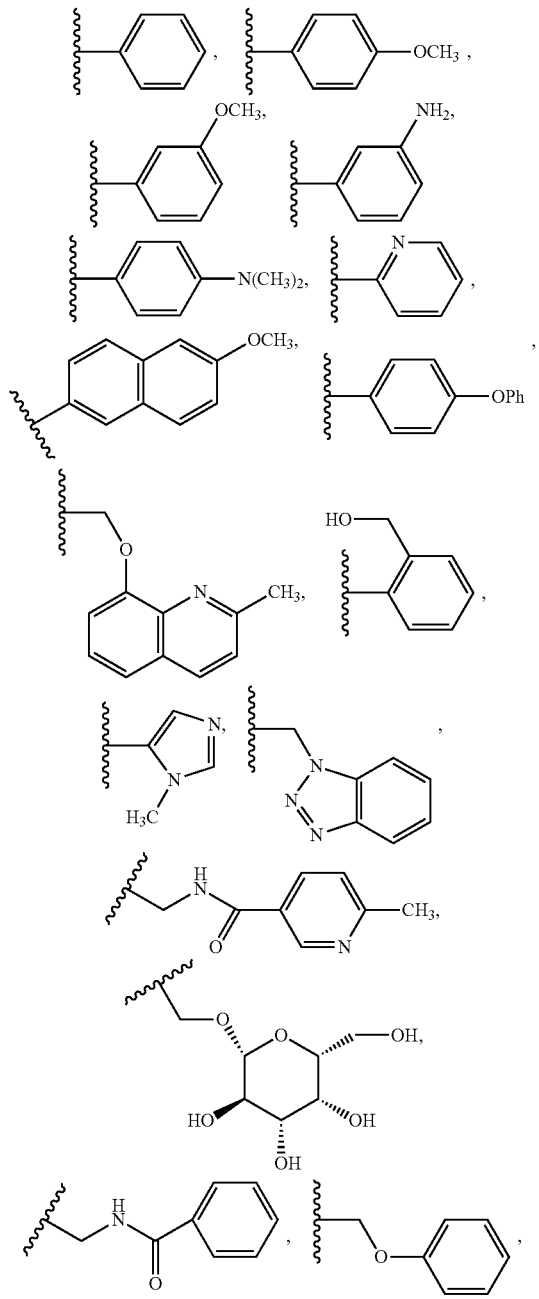

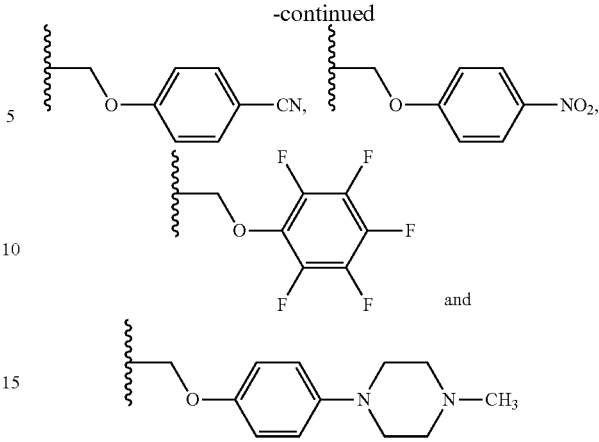

Embodiment 30

The compound of any of embodiments 1 to 17 wherein $R_2$ is selected from $N_3$, CN, I and $SCH_3$.

Embodiment 31

The compound of embodiment 30 wherein $R_2$ is I.

Embodiment 32

The compound of any of embodiments 1 to 31 wherein Y is O.

Embodiment 33

The compound of any of embodiments 1 to 31 wherein Y is S.

Embodiment 34

The compound of any of embodiments 1 to 31 wherein Y is $CJ_4J_5$.

Embodiment 35

The compound of any of embodiments 1 to 31 wherein Y is $CH_2$.

Embodiment 36

The compound of any of embodiments 1 to 31 wherein Y is $NJ_6$.

Embodiment 37

The compound of any of embodiments 1 to 31 wherein Y is $NH_2$.

Embodiment 38

The compound of any of embodiments 1 to 31 wherein Y is $N(CH_3)_2$.

Embodiment 39

The compound of any of embodiments 1 to 31 wherein Y is $N(J_6)C(=O)$.

Embodiment 40

The compound of any of embodiments 1 to 31 wherein Y is N(H)C(=O).

Embodiment 41

The compound of any of embodiments 1 to 31 wherein Y is N(CH₃)C(=O).

Embodiment 42

The compound of any of embodiments 3 to 36 wherein L optionally comprises one or more amides and wherein L attaches to T₁ through a group selected from among:

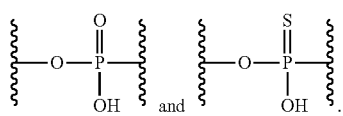

Embodiment 43

The compound of any of embodiments 3 to 37 wherein L comprises a phosphorus linking group, NH₂, or N(CH₃)₂.

Embodiment 44

The compound of any of embodiments 3 to 38 wherein L comprises a cleavable bond.

Embodiment 45

The compound of any of embodiments 1 or 2 having the configuration:

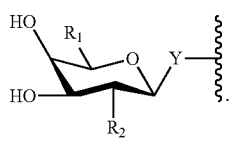

Embodiment 46

The compound of any of embodiments 1 or 2 having the configuration:

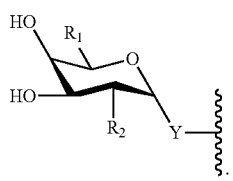

Embodiment 47

The compound of any of embodiments 3 to 39 having the configuration:

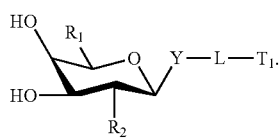

Embodiment 48

The compound of any of embodiments 3 to 39 having the configuration:

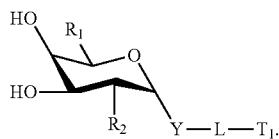

Embodiment 49

A compound comprising an oligomer and a conjugate group, wherein the conjugate group comprises from 2 to 4 moieties having Formula I:

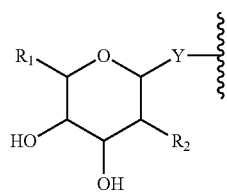

wherein independently for each moiety having formula I:
$R_1$ is selected from $Q_1$, $CH_2Q_1$, $CH_2OH$, $CH_2NJ_1J_2$, $CH_2N_3$ and $CH_2SJ_3$;
$Q_1$ is selected from aryl, substituted aryl, heterocyclic, substituted heterocyclic, heteroaryl and substituted heteroaryl;
$R_2$ is selected from $N_3$, CN, halogen, $N(H)C(=O)-Q_2$, substituted thiol, aryl, substituted aryl, heterocyclic, substituted heterocyclic, heteroaryl and substituted heteroaryl;
$Q_2$ is selected from H, $C_1$-$C_6$ alkyl, substituted $C_1$-$C_6$ alkyl, $C_1$-$C_6$ alkoxy, substituted $C_1$-$C_6$ alkoxy, aryl, substituted aryl, heterocyclic, substituted heterocyclic, heteroaryl and substituted heteroaryl;
Y is selected from O, S, $CJ_4J_5$, $NJ_6$ and $N(J_6)C(=O)$;
$J_1$, $J_2$, $J_3$, $J_4$, $J_5$, and $J_6$ are each, independently, H or a substituent group;
each substituent group is, independently, mono or poly substituted with optionally protected substituent groups independently selected from halogen, $C_1$-$C_6$ alkyl, $C_1$-$C_6$ alkoxy, aryl, heterocyclic and heteroaryl wherein each substituent group can include a linear or branched alkylene group optionally including one or more groups independently selected from O, S, NH and C(=O), and wherein each substituent group may be further substituted with one or more groups independently selected from $C_1$-$C_6$ alkyl, halogen or $C_1$-$C_6$ alkoxy wherein each cyclic group is mono or polycyclic; and for at least one moiety of formula I when Y is O and R₁ is OH then R₂ is other than OH and N(H)C(=O)CH₃.

Embodiment 50

The compound of embodiment 49 wherein each moiety having Formula I is linked to the oligomer through a connecting group wherein the connecting group comprises at least one branching group.

Embodiment 51

The compound of any of embodiments 49 or 50 wherein each R₁ is, independently, selected from Q₁ and CH₂Q₁.

Embodiment 52

The compound of any of embodiments 49 to 51 wherein each Q₁ is substituted heteroaryl.

Embodiment 53

The compound of embodiment 52 wherein each Q₁ is selected from among:

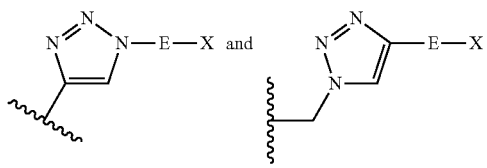

wherein:
E is a single bond or one of said linear or branched alkylene groups; and
X is H or one of said substituent groups.

Embodiment 54

The compound of embodiment 53 wherein each X is selected from substituted aryl and substituted heteroaryl.

Embodiment 55

The compound of embodiment 54 wherein each X is phenyl or substituted phenyl comprising one or more substituent groups selected from F, Cl, Br, CO₂Et, OCH₃, CN, CH₃, OCH₃, CF₃, N(CH₃)₂ and O-phenyl.

Embodiment 56

The compound of embodiment 53 wherein each Q₁ has the formula:

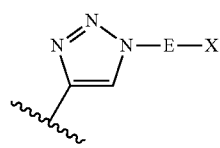

wherein:
-E-X is selected from among:

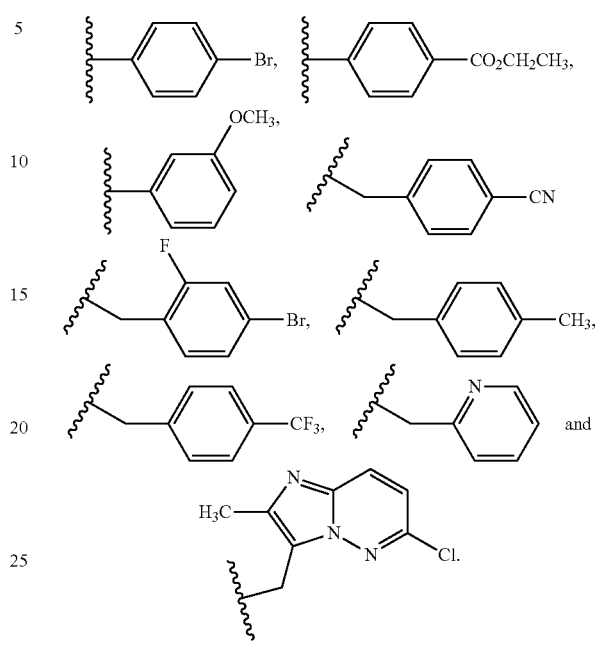

Embodiment 57

The compound of embodiment 53 wherein each Q₁ has the formula:

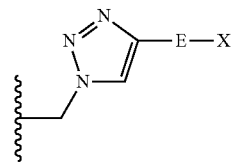

wherein:
-E-X is selected from among:

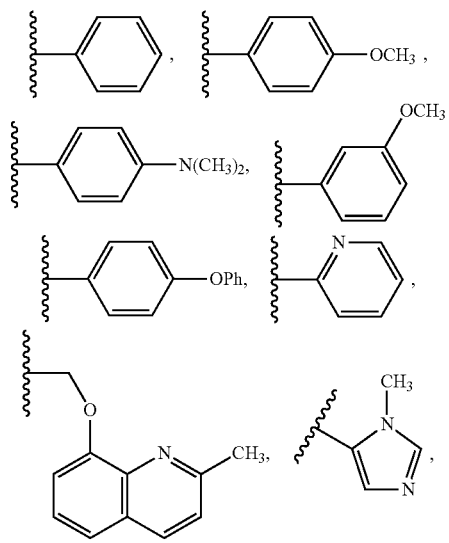

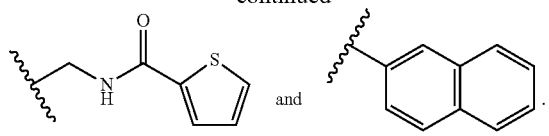

Embodiment 58

The compound of any of embodiments 49 to 50 wherein each $R_1$ is selected from $CH_2OH$, $CH_2NJ_1J_2$, $CH_2N_3$ and $CH_2SJ_3$ wherein $J_1$, $J_2$ and $J_3$ are each independently selected from H and $CH_3$.

Embodiment 59

The compound of embodiment 58 wherein each $J_1$, $J_2$ and $J_3$ are each H.

Embodiment 60

The compound of embodiment 58 wherein each $J_1$, $J_2$ and $J_3$ are each $CH_3$.

Embodiment 61

The compound of any of embodiments 49 to 60 wherein each $R_2$ is $N(H)C(=O)-Q_2$.

Embodiment 62

The compound of embodiment 61 wherein each $Q_2$ is selected from $C_1$-$C_6$ alkyl, substituted $C_1$-$C_6$ alkyl, $C_1$-$C_6$ alkoxy and substituted $C_1$-$C_6$ alkoxy.

Embodiment 63

The compound of embodiment 62 wherein each $Q_2$ is selected from $CH_3$, $CH_2CH_3$, $CH(CH_3)_2$, $(CH_2)_2CH_3$, $C(CH_3)_3$, $CCl_3$, $CF_3$, $O-C(CH_3)_3$, $CH_2CO_2H$, $CH_2NH_2$ and $CH_2CF_3$.

Embodiment 64

The compound of any of embodiments 60 to 61 wherein each $Q_2$ is selected from aryl, substituted aryl, heterocyclic, substituted heterocyclic, heteroaryl and substituted heteroaryl.

Embodiment 65

The compound of embodiment 64 wherein each $Q_2$ is selected from aryl, substituted aryl, heteroaryl and substituted heteroaryl.

Embodiment 66

The compound of embodiment 65 wherein each $Q_2$ is selected is selected from among:

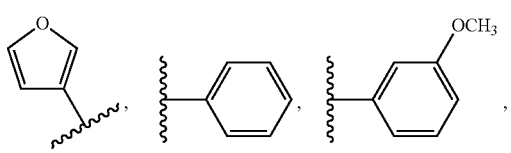

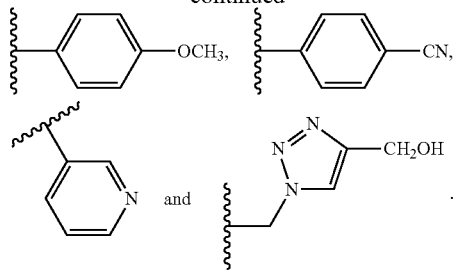

Embodiment 67

The compound of any of embodiments 49 to 60 wherein each $R_2$ is selected from aryl, substituted aryl, heterocyclic, substituted heterocyclic, heteroaryl and substituted heteroaryl.

Embodiment 68

The compound of embodiment 67 wherein each $R_2$ has the formula:

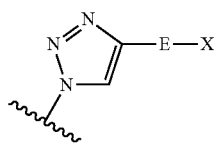

wherein:
E is a single bond or one of said linear or branched alkylene groups; and
X is H or one of said substituent groups.

Embodiment 69

The compound of embodiment 68 wherein each -E-X is selected from $CH_2OH$, $CH_2NH_2$, $CH_2N(H)CH_3$, $CH_2N(CH_3)_2$, $CO_2H$ and $CH_2NHCOCH_3$.

Embodiment 70

The compound of embodiment 68 wherein each -E-X is selected from among:

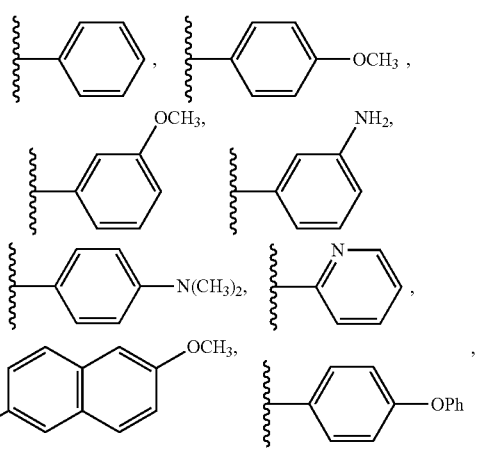

-continued

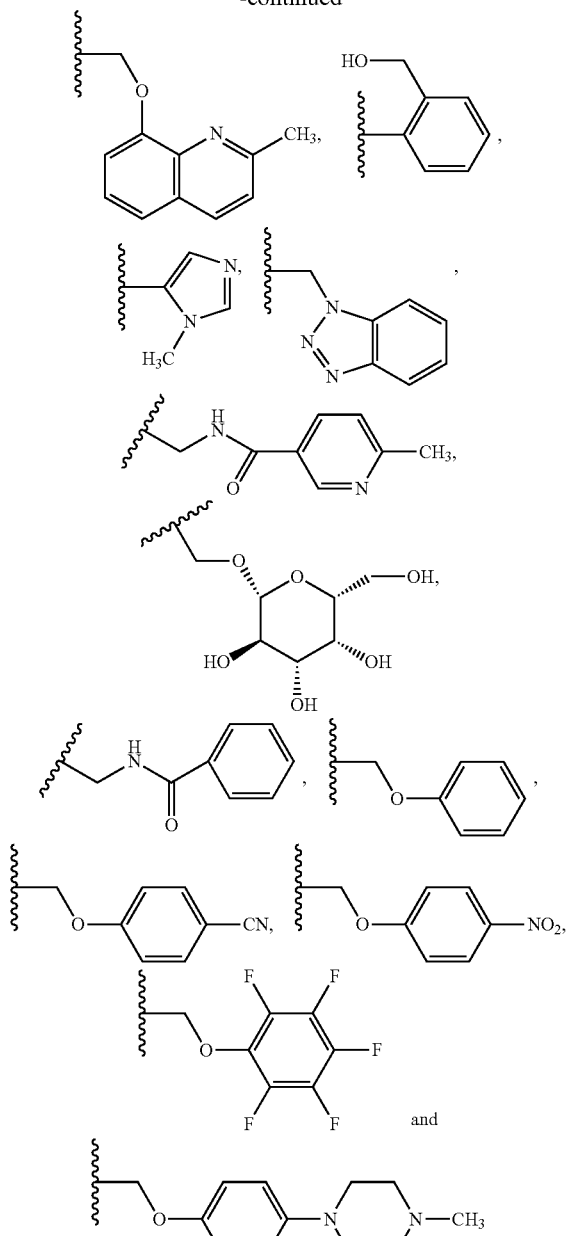

Embodiment 71

The compound of any of embodiments 49 to 60 wherein each $R_2$ is selected from $N_3$, CN, I and $SCH_3$.

Embodiment 72

The compound of embodiment 71 wherein $R_2$ is I.

Embodiment 73

The compound of any of embodiments 49 to 72 wherein each Y is O.

Embodiment 74

The compound of any of embodiments 49 to 72 wherein each Y is S.

Embodiment 75

The compound of any of embodiments 49 to 72 wherein each Y is $CJ_4J_5$.

Embodiment 76

The compound of any of embodiments 49 to 72 wherein each Y is $CH_2$.

Embodiment 77

The compound of any of embodiments 49 to 72 wherein each Y is $NJ_6$.

Embodiment 78

The compound of any of embodiments 49 to 72 wherein each Y is $NH_2$.

Embodiment 79

The compound of any of embodiments 49 to 72 wherein each Y is $N(CH_3)_2$.

Embodiment 80

The compound of any of embodiments 49 to 72 wherein each Y is $N(J_6)C(=O)$.

Embodiment 81

The compound of any of embodiments 49 to 72 wherein each Y is $N(H)C(=O)$.

Embodiment 82

The compound of any of embodiments 49 to 72 wherein each Y is $N(CH_3)C(=O)$.

Embodiment 83

The compound of any of embodiments 49 or 82 wherein each moiety of Formula I has the configuration:

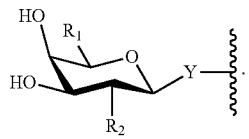

Embodiment 84

The compound of any of embodiments 49 or 82 wherein each moiety of Formula I has the configuration:

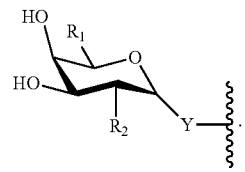

Embodiment 85

A compound comprising an oligomer and two conjugate groups, wherein the conjugate group comprises a moiety having Formula III:

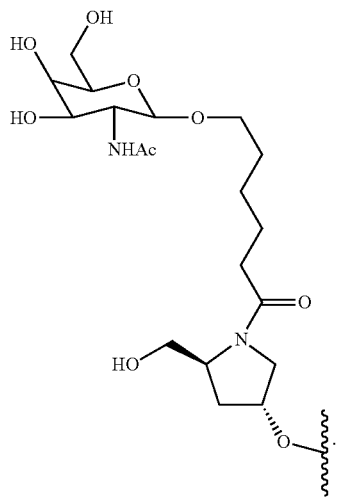

III

Embodiment 86

The compound of embodiment 85, wherein one conjugate group is attached to the 5'-most terminal nucleoside of the oligomer and the second conjugate group is attached to the 3'-most terminal nucleoside of the oligomer.

Embodiment 87

A compound comprising an oligomer and a conjugate group, wherein the conjugate group comprises a moiety having Formula IV:

Embodiment 88

The compound of embodiment 87, wherein the conjugate group consists of Formula IV and a cleavable moiety that is directly attached to the oligomer.

Embodiment 89

The compound of any of embodiments 1 to 88, wherein the oligomer comprises at least one modified nucleoside.

Embodiment 90

The compound of embodiment 89, wherein the at least one modified nucleoside comprises a modified base.

Embodiment 91

The compound of embodiment 89 or 90, wherein the at least one modified nucleoside comprises a sugar surrogate.

Embodiment 92

The compound of embodiment 91, wherein the sugar surrogate is a tetrahydropyran.

Embodiment 93

The compound of any of embodiment 92, wherein the tetrahydropyran is F-HNA.

Embodiment 94

The compound of any of embodiments 89 to 93, wherein the remainder of the oligomer comprises at least one nucleoside comprising a modified sugar.

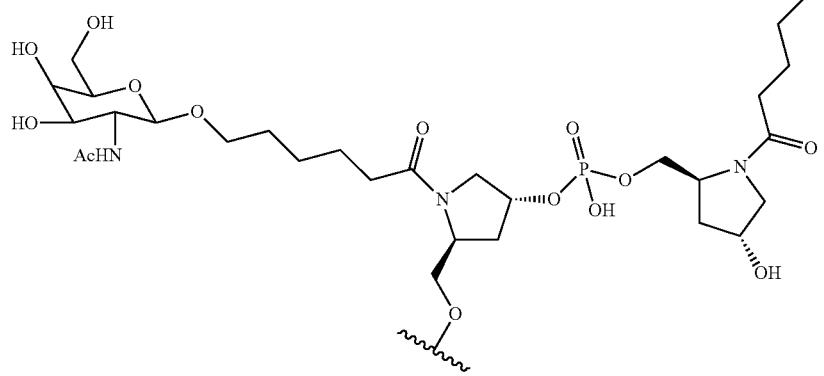

IV

Embodiment 95

The compound of embodiment 94 wherein the at least one modified nucleoside comprising a modified sugar is selected from a bicyclic nucleoside and a 2'-modified nucleoside.

Embodiment 96

The compound of embodiment 95, wherein the at least one modified nucleoside is a bicyclic nucleoside.

Embodiment 97

The compound of embodiment 96, wherein the bicyclic nucleoside is a (4'-CH$_2$—O-2') BNA nucleoside.

Embodiment 98

The compound of embodiment 97, wherein the bicyclic nucleoside is a (4'-(CH$_2$)$_2$—O-2') BNA nucleoside.

Embodiment 99

The compound of embodiment 98, wherein the bicyclic nucleoside is a (4'-C(CH$_3$)H—O-2') BNA nucleoside.

Embodiment 100

The compound of embodiment 95, wherein the at least one modified nucleoside is a 2'-modifed nucleoside.

Embodiment 101

The compound of embodiment 100, wherein the at least one 2'-modified nucleoside is selected from a 2'-F nucleoside, a 2'-OCH$_3$ nucleoside, and a 2'-O(CH$_2$)$_2$OCH$_3$ nucleoside.

Embodiment 102

The compound of embodiment 100, wherein the at least one 2'-modified nucleoside is a 2'-F nucleoside.

Embodiment 103

The compound of embodiment 100, wherein the at least one 2'-modified nucleoside is a 2'-OCH$_3$ nucleoside.

Embodiment 104

The compound of embodiment 100, wherein the at least one 2'-modified nucleoside is a 2'-O(CH$_2$)$_2$OCH$_3$ nucleoside.

Embodiment 105

The compound of any of embodiments 89-104, wherein the compound comprises at least one unmodified nucleoside.

Embodiment 106

The compound of embodiment 105, wherein the unmodified nucleoside is a ribonucleoside.

Embodiment 107

The compound of embodiment 105, wherein the unmodified nucleoside is a deoxyribonucleoside.

Embodiment 108

The compound of any of embodiments 89 to 107, wherein the compound comprises at least two modified nucleosides.

Embodiment 109

The compound of embodiment 108, wherein the at least two modified nucleosides comprise the same modification.

Embodiment 110

The compound of embodiment 108, wherein the at least two modified nucleosides comprise different modifications.

Embodiment 111

The compound of any of embodiments 108 to 110, wherein at least one of the at least two modified nucleosides comprises a sugar surrogate.

Embodiment 112

The compound of any of embodiments 108 to 111, wherein at least one of the at least two modified nucleosides comprises a 2'-modification.

Embodiment 113

The compound of embodiment 112, wherein each of the at least two modified nucleosides is independently selected from 2'-F nucleosides, 2'-OCH$_3$ nucleosides and 2'-O(CH$_2$)$_2$OCH$_3$ nucleosides.

Embodiment 114

The compound of embodiment 113, wherein each of the at least two modified nucleosides is a 2'-F nucleoside.

Embodiment 115

The compound of embodiment 113 wherein each of the at least two modified nucleosides is a 2'-OCH$_3$ nucleosides.

Embodiment 116

The compound of embodiment 113 wherein each of the at least two modified nucleosides is a 2'-O(CH$_2$)$_2$OCH$_3$ nucleoside.

Embodiment 117

The compound of any of embodiments 89 to 116, wherein essentially every nucleoside of the oligomer is a modified nucleoside.

Embodiment 118

The compound of any of embodiments 89 to 104 or 110 to 117, wherein every nucleoside of the oligomer is a modified nucleoside.

Embodiment 119

The compound of any of embodiments 89 to 118, wherein the oligomer is single-stranded.

Embodiment 120

The compound of any of embodiments 89 to 118, wherein the oligomer is double-stranded.

Embodiment 121

The compound of any of embodiments 89 to 118, wherein the oligomer is an antisense compound.

Embodiment 122

The compound of any of embodiments 89 to 118, wherein the oligomer is a RISC based oligomer.

Embodiment 123

The compound of any of embodiments 89 to 118, wherein the oligomer activates the RISC pathway.

Embodiment 124

The compound of any of embodiments 89 to 118, wherein the oligomer is an RNase H based antisense compound.

Embodiment 125

The compound of any of embodiments 89 to 124, wherein the conjugate group is attached to the 5'-terminal nucleoside of the oligomer.

Embodiment 126

The compound of any of embodiments 89 to 124, wherein the conjugate group is attached to the 3'-terminal nucleoside of the oligomer.

Embodiment 127

The compound of any of embodiments 89 to 124, wherein the conjugate group is attached to an internal nucleoside of the oligomer.

Embodiment 128

The compound of any of embodiments 89 to 124, wherein the conjugate group increases uptake of the oligomer into a hepatocyte relative to an unconjugated oligomer.

Embodiment 129

The compound of any of embodiments 89 to 124, wherein the conjugate group increases the affinity of the oligomer for a liver cell relative to an unconjugated oligomer.

Embodiment 130

The compound of any of embodiments 89 to 124, wherein the conjugate group increases accumulation of the oligomer in the liver relative to an unconjugated oligomer.

Embodiment 131

The compound of any of embodiments 89 to 124, wherein the conjugate group decreases accumulation of the oligomer in the kidneys relative to an unconjugated oligomer.

Embodiment 132

The compound of embodiment 89 to 116 or 119 to 131, wherein the oligomer has a sugar motif comprising:

a 5'-region consisting of 2-8 linked 5'-region nucleosides, wherein at least two 5'-region nucleosides are modified nucleosides and wherein the 3'-most 5'-region nucleoside is a modified nucleoside;

a 3'-region consisting of 2-8 linked 3'-region nucleosides, wherein at least two 3'-region nucleosides are modified nucleosides and wherein the 5'-most 3'-region nucleoside is a modified nucleoside; and a central region between the 5'-region and the 3'-region consisting of 5-10 linked central region nucleosides, each independently selected from among: a modified nucleoside and an unmodified deoxynucleoside, wherein the 5'-most central region nucleoside is an unmodified deoxynucleoside and the 3'-most central region nucleoside is an unmodified deoxynucleoside.

Embodiment 133

The compound of embodiment 132, wherein the 5'-region consists of 2 linked 5'-region nucleosides.

Embodiment 134

The compound of embodiment 132, wherein the 5'-region consists of 3 linked 5'-region nucleosides.

Embodiment 135

The compound of embodiment 132, wherein the 5'-region consists of 4 linked 5'-region nucleosides.

Embodiment 136

The compound of embodiment 132, wherein the 5'-region consists of 5 linked 5'-region nucleosides.

Embodiment 137

The compound of any of embodiments 132-136, wherein the 3'-region consists of 2 linked 3'-region nucleosides.

Embodiment 138

The compound of any of embodiments 132-136, wherein the 3'-region consists of 3 linked 3'-region nucleosides.

Embodiment 139

The compound of any of embodiments 132-136, wherein the 3'-region consists of 4 linked 3'-region nucleosides.

Embodiment 140

The compound of any of embodiments 132-136, wherein the 3'-region consists of 5 linked 3'-region nucleosides.

Embodiment 141

The compound of any of embodiments 132-140, wherein the central region consists of 5 linked central region nucleosides.

Embodiment 142

The compound of any of embodiments 132-140, wherein the central region consists of 6 linked central region nucleosides.

Embodiment 143

The compound of any of embodiments 132-140, wherein the central region consists of 7 linked central region nucleosides.

Embodiment 144

The compound of any of embodiments 132-140, wherein the central region consists of 8 linked central region nucleosides.

Embodiment 145

The compound of any of embodiments 132-140, wherein the central region consists of 9 linked central region nucleosides.

Embodiment 146

The compound of any of embodiments 132-140, wherein the central region consists of 10 linked central region nucleosides.

Embodiment 147

The compound of any of embodiments 132-146, wherein the compound consists of 14 to 26 linked nucleosides.

Embodiment 148

The compound of any of embodiments 132-146, wherein the compound consists of 15 to 25 linked nucleosides.

Embodiment 149

The compound of any of embodiments 132-146, wherein the compound consists of 16 to 20 linked nucleosides.

Embodiment 150

The compound of any of embodiments 132-149, wherein each modified nucleoside independently comprises a 2'-substituted sugar moiety or a bicyclic sugar moiety.

Embodiment 151

The compound of embodiment 150, wherein the at least one modified nucleoside of the oligomer comprises a 2'-substituted sugar moiety.

Embodiment 152

The compound of embodiment 151, wherein each modified nucleoside comprising a 2'-substituted sugar moiety comprises a 2' substituent independently selected from among: halogen, optionally substituted allyl, optionally substituted amino, azido, optionally substituted SH, CN, OCN, CF3, OCF3, O, S, or N(Rm)-alkyl; O, S, or N(Rm)-alkenyl; O, S or N(Rm)-alkynyl; optionally substituted O-alkylenyl-O-alkyl, optionally substituted alkynyl, optionally substituted alkaryl, optionally substituted aralkyl, optionally substituted O-alkaryl, optionally substituted O-aralkyl, O(CH2)2SCH3, O—(CH2)2-O—N(Rm)(Rn) or O—CH2-C(=O)—N(Rm)(Rn), where each Rm and Rn is, independently, H, an amino protecting group or substituted or unsubstituted $C_1$-$C_{10}$ alkyl;

wherein each optionally substituted group is optionally substituted with a substituent group independently selected from among: hydroxyl, amino, alkoxy, carboxy, benzyl, phenyl, nitro ($NO_2$), thiol, thioalkoxy (S-alkyl), halogen, alkyl, aryl, alkenyl and alkynyl.

Embodiment 153

The compound of embodiment 151, wherein each 2' substituent is independently selected from among: a halogen, $OCH_3$, $OCH_2F$, $OCHF_2$, $OCF_3$, $OCH_2CH_3$, $O(CH_2)_2F$, $OCH_2CHF_2$, $OCH_2CF_3$, $OCH_2$—CH—$CH_2$, $O(CH_2)_2$—$OCH_3$, $O(CH_2)_2$—$SCH_3$, $O(CH_2)_2$—$OCF_3$, $O(CH_2)_3$—$N(R_1)(R_2)$, $O(CH_2)_2$—$ON(R_1)(R_2)$, $O(CH_2)_2$—$O(CH_2)_2$—$N(R_1)(R_2)$, $OCH_2C(=O)$—$N(R_1)(R_2)$, $OCH_2C(=O)$—$N(R_3)$—$(CH_2)_2$—$N(R_1)(R_2)$, and $O(CH_2)_2$—$N(R_3)$—$C(=NR_4)[N(R_1)(R_2)]$; wherein $R_1$, $R_2$, $R_3$ and $R_4$ are each, independently, H or $C_1$-$C_6$ alkyl.

Embodiment 154

The compound of embodiment 151, wherein each 2' substituent is independently selected from among: a halogen, $OCH_3$, $OCF_3$, $OCH_2CH_3$, $OCH_2CF_3$, $OCH_2$—CH=$CH_2$, $O(CH_2)_2$—$OCH_3$ (MOE), $O(CH_2)_2$—O$(CH_2)_2$—$N(CH_3)_2$, $OCH_2C(=O)$—$N(H)CH_3$, $OCH_2C(=O)$—$N(H)$—$(CH_2)_2$—$N(CH_3)_2$, and $OCH_2$—$N(H)$—$C(=NH)NH_2$.

Embodiment 155

The compound of embodiment 151, wherein the at least one 2'-modified nucleoside comprises a 2'-MOE sugar moiety.

Embodiment 156

The compound of embodiment 151, wherein the at least one 2'-modified nucleoside comprises a 2'-OMe sugar moiety.

Embodiment 157

The compound of embodiment 151, wherein the at least one 2'-modified nucleoside comprises a 2'-F sugar moiety.

Embodiment 158

The compound of any of embodiments 132-157, wherein the oligomer comprises at least one modified nucleoside comprising a sugar surrogate.

Embodiment 159

The compound of embodiment 158, wherein the modified nucleoside comprises an F-HNA sugar moiety.

Embodiment 160

The compound of embodiment 158, wherein the modified nucleoside comprises an HNA sugar moiety.

Embodiment 161

The compound of any of embodiments 132-149 wherein the oligomer comprises at least one modified nucleoside comprising a bicyclic sugar moiety.

Embodiment 162

The compound of embodiment 161, wherein the bicyclic sugar moiety is a cEt sugar moiety.

Embodiment 163

The compound of embodiment 161, wherein bicyclic sugar moiety is an LNA sugar moiety.

Embodiment 164

The compound of any of embodiments 89 to 163, wherein the oligomer comprises at least one modified internucleoside linkage.

Embodiment 165

The compound of any of embodiments 89 to 163, wherein each internucleoside linkage of the oligomer is a modified internucleoside linkage.

Embodiment 166

The compound of embodiment 164, wherein the oligomer comprises at least one modified linkage and at least one unmodified phosphodiester internucleoside linkage.

Embodiment 167

The compound of any of embodiments 164 or 166, wherein at least one modified internucleoside linkage is a phosphosphorothioate internucleoside linkage.

Embodiment 168

The compound of any of embodiments 164 or 166, wherein each modified internucleoside linkage is a phosphorothioate internucleoside linkage.

Embodiment 169

The compound of any of embodiments 164 or 166, wherein the oligomer comprises at least 2 phosphodiester internucleoside linkages.

Embodiment 170

The compound of any of embodiments 164 or 166, wherein the oligomer comprises at least 3 phosphodiester internucleoside linkages.

Embodiment 171

The compound of any of embodiments 164 or 166, wherein the oligomer comprises at least 4 phosphodiester internucleoside linkages.

Embodiment 172

The compound of any of embodiments 164 or 166, wherein the oligomer comprises at least 5 phosphodiester internucleoside linkages.

Embodiment 173

The compound of any of embodiments 164 or 166, wherein the oligomer comprises at least 6 phosphodiester internucleoside linkages.

Embodiment 174

The compound of any of embodiments 164 or 166, wherein the oligomer comprises at least 7 phosphodiester internucleoside linkages.

Embodiment 175

The compound of any of embodiments 164 or 166, wherein the oligomer comprises at least 8 phosphodiester internucleoside linkages.

Embodiment 176

The compound of any of embodiments 164 or 166, wherein the oligomer comprises at least 9 phosphodiester internucleoside linkages.

Embodiment 177

The compound of any of embodiments 164 or 166, wherein the oligomer comprises at least 10 phosphodiester internucleoside linkages.

Embodiment 178

The compound of any of embodiments 164 or 166 to 177, wherein the oligomer comprises fewer than 16 phosphorothioate internucleoside linkages.

Embodiment 179

The compound of any of embodiments 164 or 166 to 177, wherein the oligomer comprises fewer than 15 phosphorothioate internucleoside linkages.

Embodiment 180

The compound of any of embodiments 164 or 166 to 177, wherein the oligomer comprises fewer than 14 phosphorothioate internucleoside linkages.

Embodiment 181

The compound of any of embodiments 164 or 166 to 177, wherein the oligomer comprises fewer than 13 phosphorothioate internucleoside linkages.

Embodiment 182

The compound of any of embodiments 164 or 166 to 177, wherein the oligomer comprises fewer than 12 phosphorothioate internucleoside linkages.

Embodiment 183

The compound of any of embodiments 164 or 166 to 177, wherein the oligomer comprises fewer than 11 phosphorothioate internucleoside linkages.

Embodiment 184

The compound of any of embodiments 164 or 166 to 177, wherein the oligomer comprises fewer than 10 phosphorothioate internucleoside linkages.

Embodiment 185

The compound of any of embodiments 164 or 166 to 177, wherein the oligomer comprises fewer than 9 phosphorothioate internucleoside linkages.

Embodiment 186

The compound of any of embodiments 164 or 166 to 177, wherein the oligomer comprises fewer than 8 phosphorothioate internucleoside linkages.

Embodiment 187

The compound of any of embodiments 164 or 166 to 177, wherein the oligomer comprises fewer than 7 phosphorothioate internucleoside linkages.

Embodiment 188

The compound of any of embodiments 164 or 166 to 177, wherein the oligomer comprises fewer than 6 phosphorothioate internucleoside linkages.

Embodiment 189

The compound of any of embodiments 89 to 188, wherein each terminal internucleoside linkage of the oligomer is a phosphorothioate internucleoside linkage.

Embodiment 190

The compound of any of embodiments 89 to 175 or 178 to 179, wherein each internucleoside linkage linking two deoxynucleosides of the oligomer is a phosphorothioate internucleoside linkage.

Embodiment 191

The compound of any of embodiments 89 to 175 or 178 to 190, wherein each non-terminal internucleoside linkage linking two modified nucleosides of the oligomer is a phosphodiester internucleoside linkage.

Embodiment 192

The compound of any of embodiments 89 to 175 or 178 to 191, wherein each non-terminal internucleoside linkage of the oligomer that is 3' of a modified nucleoside is a phosphodiester internucleoside linkage.

Embodiment 193

The compound of any of embodiments 89 to 175 or 178 to 192, wherein each internucleoside linkage of the oligomer that is 3' of a deoxynucleoside is a phosphorothioate internucleoside linkage.

Embodiment 194

The compound of any of embodiments 89 to 175 or 178 to 193, wherein the oligomer has a chemical motif selected from among:

MsMy(Ds)$_{0-1}$(DsDs)$_{(3-5)}$MsM
MsMy(Ds)$_{0-1}$(DsDs)$_{(3-5)}$MyMsM
MsMy(Ds)$_{0-1}$(DsDs)$_{(3-5)}$MyMyMsM
MsMy(Ds)$_{0-1}$(DsDs)$_{(3-5)}$MyMyMyMsM
MsMyMy(Ds)$_{0-1}$(DsDs)$_{(3-5)}$MsM
MsMyMy(Ds)$_{0-1}$(DsDs)$_{(3-5)}$MyMsM
MsMyMy(Ds)$_{0-1}$(DsDs)$_{(3-5)}$MyMyMsM
MsMyMy(Ds)$_{0-1}$(DsDs)$_{(3-5)}$MyMyMyMsM
MsMyMyMy(Ds)$_{0-1}$(DsDs)$_{(3-5)}$MsM
MsMyMyMy(Ds)$_{0-1}$(DsDs)$_{(3-5)}$MyMsM
MsMyMyMy(Ds)$_{0-1}$(DsDs)$_{(3-5)}$MyMyMsM
MsMyMyMy(Ds)$_{0-1}$(DsDs)$_{(3-5)}$MyMyMyMsM
MsMyMyMyMy(Ds)$_{0-1}$(DsDs)$_{(3-5)}$MsM
MsMyMyMyMy(Ds)$_{0-1}$(DsDs)$_{(3-5)}$MyMsM
MsMyMyMyMy(Ds)$_{0-1}$(DsDs)$_{(3-5)}$MyMyMsM; and
MsMyMyMyMy(Ds)$_{0-1}$(DsDs)$_{(3-5)}$MyMyMyMsM;

wherein each M is independently a modified nucleoside, each D is a deoxynucleoside; each s is a phosphorothioate internucleoside linkage, and each y is either a phosphodiester internucleoside linkage or a phosphorothioate internucleoside linkage, provided that at least one y is a phosphodiester internucleotide linkage.

Embodiment 195

The compound of any of embodiments 89 to 175 or 178 to 193, wherein the oligomers has a chemical motif selected from among:

MsMo(Ds)$_{0-1}$(DsDs)$_{(3-5)}$MoMsM
MsMo(Ds)$_{0-1}$(DsDs)$_{(3-5)}$MoMoMsM
MsMo(Ds)$_{0-1}$(DsDs)$_{(3-5)}$MoMoMoMsM
MsMoMo(Ds)$_{0-1}$(DsDs)$_{(3-5)}$MsM
MsMoMo(Ds)$_{0-1}$(DsDs)$_{(3-5)}$MoMsM
MsMoMo(Ds)$_{0-1}$(DsDs)$_{(3-5)}$MoMoMsM
MsMoMo(Ds)$_{0-1}$(DsDs)$_{(3-5)}$MoMoMoMsM
MsMoMoMo(Ds)$_{0-1}$(DsDs)$_{(3-5)}$MsM
MsMoMoMo(Ds)$_{0-1}$(DsDs)$_{(3-5)}$MoMsM
MsMoMoMo(Ds)$_{0-1}$(DsDs)$_{(3-5)}$MoMoMsM
MsMoMoMo(Ds)$_{0-1}$(DsDs)$_{(3-5)}$MoMoMoMsM
MsMoMoMoMo(Ds)$_{0-1}$(DsDs)$_{(3-5)}$MsM
MsMoMoMoMo(Ds)$_{0-1}$(DsDs)$_{(3-5)}$MoMsM
MsMoMoMoMo(Ds)$_{0-1}$(DsDs)$_{(3-5)}$MoMoMsM; and
MsMoMoMoMo(Ds)$_{0-1}$(DsDs)$_{(3-5)}$MoMoMoMsM;

wherein each M is independently a modified nucleoside, each D is a deoxynucleoside; each o is a phosphodiester internucleoside linkage, and each s is a phosphorothioate internucleoside linkage.

Embodiment 196

The compound of embodiment 194 or 195, wherein each M is independently selected from among: a 2'-MOE nucleoside and a bicyclic nucleoside.

Embodiment 197

The compound of embodiment 196, wherein each M is independently selected from among a 2'substituted sugar moiety or a bicyclic nucleoside.

Embodiment 198

The compound of embodiment 196 or 197, wherein each M is a 2'-MOE nucleoside.

Embodiment 199

The compound of embodiment 196 or 197, wherein each M is a cEt nucleoside.

Embodiment 200

The compound of embodiments 196 or 197, wherein each M is an LNA nucleoside.

Embodiment 201

The compound of any of embodiments 89 to 200, wherein the oligomer has a nucleobase sequence comprising an at least 8 nucleobase portion complementary to an equal length portion of a target nucleic acid.

Embodiment 202

The compound of any of embodiments 89 to 200, wherein the oligomer has a nucleobase sequence comprising an at least 10 nucleobase portion complementary to an equal length portion of a target nucleic acid.

Embodiment 203

The compound of any of embodiments 89 to 200, wherein the oligomer has a nucleobase sequence comprising an at least 12 nucleobase portion complementary to an equal length portion of a target nucleic acid.

Embodiment 204

The compound of any of embodiments 89 to 200, wherein the oligomer has a nucleobase sequence comprising an at least 14 nucleobase portion complementary to an equal length portion of a target nucleic acid.

Embodiment 205

The compound of any of embodiments 89 to 200, wherein the oligomer has a nucleobase sequence comprising an at least 16 nucleobase portion complementary to an equal length portion of a target nucleic acid.

Embodiment 206

The compound of any of embodiments 89 to 200, wherein the oligomer has a nucleobase sequence comprising an at least 18 nucleobase portion complementary to an equal length portion of a target nucleic acid.

Embodiment 207

The compound of any of embodiments 89 to 200, wherein the oligomer is at least 90% complementary to a target nucleic acid.

Embodiment 208

The compound of any of embodiments 89 to 200, wherein the oligomer is at least 95% complementary to a target nucleic acid.

Embodiment 209

The compound of any of embodiments 89 to 200, wherein the oligomer is 100% complementary to a target nucleic acid.

Embodiment 210

The compound of any of embodiments 201 to 209, wherein the target nucleic acid is a pre-mRNA.

Embodiment 211

The compound of any of embodiments 201 to 209, wherein the target nucleic acid is an mRNA.

Embodiment 212

The compound of any of embodiments 201 to 209, wherein the target nucleic acid is a micro RNA.

Embodiment 213

The compound of any of embodiments 201 to 209, wherein the target nucleic acid is expressed in the liver.

Embodiment 214

The compound r of any of embodiments 201 to 209, wherein the target nucleic acid is expressed in hepatocytes.

Embodiment 215

The compound of any of embodiments 201 to 209, wherein the target nucleic acid has the nucleobase sequence of any one of SEQ ID NOs.: 1, 2, 3, 4, 5, 6, 7, 8, 9, 10, 11, 12, 13, 14, 15, or 16.

Embodiment 216

The compound of any of embodiments 201 to 209, wherein the target nucleic encodes a protein selected from among: Alpha 1 antitrypsin, Androgen Receptor, Apolipoprotein (a), Apolipoprotein B, Apolipoprotein C—III, C-Reactive Protein, eIF-4E, Factor VII, Factor XI, Glucocorticoid Receptor, Glucagon Receptor, HBV, Protein Tyrosine Phosphatase 1B, STAT3, SRB-1, Transthyretin, PCSK9, angiopoietin-like 3, plasma prekallikrein, and growth hormone receptor.

Embodiment 217

The compound of any of embodiments 201 to 212 wherein the target nucleic acid is a viral nucleic acid.

Embodiment 218

The compound of embodiment 216, wherein the viral nucleic acid expressed in the liver.

Embodiment 219

The compound of embodiment 216, wherein the target nucleic acid is a Hepatitis B viral nucleic acid.

Embodiment 220

The compound of embodiment 216, wherein the target nucleic acid is a HCV viral nucleic acid.

Embodiment 221

The compound of any of embodiments 89 to 211, wherein the oligomer comprises the nucleobase sequence of any one of SEQ ID NOs.: 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, or 140.

Embodiment 222

The compound of any of embodiments 89 to 211, wherein the oligomer comprises the nucleobase sequence of any one of SEQ ID NO.: 25, 26, 27, 28, 29, or 30.

Embodiment 223

The compound of any of embodiments 89 to 211, wherein the oligomer comprises the nucleobase sequence of SEQ ID NO.: 31.

Embodiment 224

The compound of any of embodiments 89 to 211, wherein the oligomer comprises the nucleobase sequence of SEQ ID NO.: 32.

Embodiment 225

The compound of any of embodiments 89 to 211, wherein the oligomer comprises the nucleobase sequence of SEQ ID NO.: 33.

Embodiment 226

The compound of any of embodiments 89 to 211, wherein the oligomer comprises the nucleobase sequence of SEQ ID NO.: 34.

Embodiment 227

The compound of any of embodiments 89 to 211, wherein the oligomer comprises the nucleobase sequence of any of SEQ ID NOs.: 35, 36, 37, 38, 39, 40, 41, 42, or 43.

Embodiment 228

The compound of any of embodiments 89 to 211, wherein the oligomer comprises the nucleobase sequence of SEQ ID NO.: 44, 45, 46, 47, or 48.

Embodiment 229

The compound of any of embodiments 89 to 211, wherein the oligomer comprises the nucleobase sequence of any of SEQ ID NOs.: 49, 50, 51, 52, 53, 54, 55, 56, 57, 58, or 59.

Embodiment 230

The compound of any of embodiments 89 to 211, wherein the oligomer comprises the nucleobase sequence of any of SEQ ID NOs.: 60, 61, 62, 63, 64, 65, 66, or 67.

Embodiment 231

The compound of any of embodiments 89 to 211, wherein the oligomer comprises the nucleobase sequence of any of SEQ ID NO.: 69, 70, 71, or 72.

Embodiment 232

The compound of any of embodiments 89 to 211, wherein the oligomer comprises the nucleobase sequence of SEQ ID NO.: 73.

Embodiment 233

The compound of any of embodiments 89 to 211, wherein the oligomer comprises the nucleobase sequence of any of SEQ ID NOs.: 74, 75, 76, 77, 78, 79, 80, or 81.

Embodiment 234

The compound of any of embodiments 89 to 211, wherein the oligomer comprises the nucleobase sequence of SEQ ID NO.: 68.

Embodiment 235

The compound of any of embodiments 89 to 211, wherein the oligomer comprises the nucleobase sequence of any of SEQ ID NOs.: 82-103, 111, or 113.

Embodiment 236

The compound of any of embodiments 89 to 226, wherein the oligomer is an antisense oligomer.

Embodiment 237

The compound of any of embodiments 1 to 236, wherein the conjugate group does not comprise PEG.

Embodiment 238

The compound of any of embodiments 2 to 84 or 89 to 236, wherein the connecting group does not comprise PEG.

Embodiment 239

The compound of any of embodiments 1 to 84 or 89 to 236, wherein the linking group does not comprise PEG.

Embodiment 240

A pharmaceutical composition comprising a compound or oligomer according to any of embodiments 1 to 239 and a pharmaceutically acceptable carrier or diluent.

Embodiment 241

The pharmaceutical composition of embodiment 240 wherein the pharmaceutically acceptable carrier or diluent is selected from among sterile water and sterile saline.

Embodiment 242

Use of the compound of any of embodiments 1 to 241 for the manufacture of a medicament for the treatment of a disease or condition.

Embodiment 243

The compound of any of embodiments 1 to 241 for the treatment of a disease or condition.

In embodiments having more than one of a particular variable (e.g., more than one "m" or "n"), unless otherwise indicated, each such particular variable is selected independently. Thus, for a structure having more than one n, each n is selected independently, so they may or may not be the same as one another.

DETAILED DESCRIPTION

It is to be understood that both the foregoing general description and the following detailed description are exemplary and explanatory only and are not restrictive of the disclosure. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated by reference in their entirety for any purpose.

A. Definitions

Unless specific definitions are provided, the nomenclature used in connection with, and the procedures and techniques of, analytical chemistry, synthetic organic chemistry, and medicinal and pharmaceutical chemistry described herein are those well known and commonly used in the art. Standard techniques may be used for chemical synthesis, and chemical analysis. Certain such techniques and procedures may be found for example in "Carbohydrate Modifications in Antisense Research" Edited by Sangvi and Cook, American Chemical Society, Washington D.C., 1994; "Remington's Pharmaceutical Sciences," Mack Publishing Co., Easton, Pa., $21^{st}$ edition, 2005; and "Antisense Drug Technology, Principles, Strategies, and Applications" Edited by Stanley T. Crooke, CRC Press, Boca Raton, Fla.; and Sambrook et al., "Molecular Cloning, A laboratory Manual," $2^{nd}$ Edition, Cold Spring Harbor Laboratory Press, 1989, which are hereby incorporated by reference for any purpose. Where permitted, all patents, applications, published applications and other publications and other data referred to throughout in the disclosure are incorporated by reference herein in their entirety.

Unless otherwise indicated, the following terms have the following meanings:

As used herein, "nucleoside" means a compound comprising a nucleobase moiety and a sugar moiety. Nucleosides include, but are not limited to, naturally occurring nucleosides (as found in DNA and RNA) and modified nucleosides. Nucleosides may be linked to a phosphate moiety.

As used herein, "chemical modification" means a chemical difference in a compound when compared to a naturally occurring counterpart. Chemical modifications of oligonucleotides include nucleoside modifications (including sugar moiety modifications and nucleobase modifications) and internucleoside linkage modifications. In reference to an oligonucleotide, chemical modification does not include differences only in nucleobase sequence.

As used herein, "furanosyl" means a structure comprising a 5-membered ring comprising four carbon atoms and one oxygen atom.

As used herein, "naturally occurring sugar moiety" means a ribofuranosyl as found in naturally occurring RNA or a deoxyribofuranosyl as found in naturally occurring DNA.

As used herein, "sugar moiety" means a naturally occurring sugar moiety or a modified sugar moiety of a nucleoside.

As used herein, "modified sugar moiety" means a substituted sugar moiety or a sugar surrogate.

As used herein, "substituted sugar moiety" means a furanosyl that is not a naturally occurring sugar moiety. Substituted sugar moieties include, but are not limited to furanosyls comprising substituents at the 2'-position, the 3'-position, the 5'-position and/or the 4'-position. Certain substituted sugar moieties are bicyclic sugar moieties.

As used herein, "2'-substituted sugar moiety" means a furanosyl comprising a substituent at the 2'-position other than H or OH. Unless otherwise indicated, a 2'-substituted sugar moiety is not a bicyclic sugar moiety (i.e., the 2'-substituent of a 2'-substituted sugar moiety does not form a bridge to another atom of the furanosyl ring.

As used herein, "MOE" means —$OCH_2CH_2OCH_3$.

As used herein, "2'-F nucleoside" refers to a nucleoside comprising a sugar comprising fluorine at the 2' position. Unless otherwise indicated, the fluorine in a 2'-F nucleoside is in the ribo position (replacing the OH of a natural ribose).

As used herein the term "sugar surrogate" means a structure that does not comprise a furanosyl and that is capable of replacing the naturally occurring sugar moiety of a nucleoside, such that the resulting nucleoside sub-units are capable of linking together and/or linking to other nucleosides to form an oligomeric compound which is capable of hybridizing to a complementary oligomeric compound. Such structures include rings comprising a different number of atoms than furanosyl (e.g., 4, 6, or 7-membered rings); replacement of the oxygen of a furanosyl with a non-oxygen atom (e.g., carbon, sulfur, or nitrogen); or both a change in the number of atoms and a replacement of the oxygen. Such structures may also comprise substitutions corresponding to those described for substituted sugar moieties (e.g., 6-membered carbocyclic bicyclic sugar surrogates optionally comprising additional substituents). Sugar surrogates also include more complex sugar replacements (e.g., the non-ring systems of peptide nucleic acid). Sugar surrogates include without limitation morpholinos, cyclohexenyls and cyclohexitols.

As used herein, "bicyclic sugar moiety" means a modified sugar moiety comprising a 4 to 7 membered ring (including but not limited to a furanosyl) comprising a bridge connecting two atoms of the 4 to 7 membered ring to form a second ring, resulting in a bicyclic structure. In certain embodiments, the 4 to 7 membered ring is a sugar ring. In certain embodiments the 4 to 7 membered ring is a furanosyl. In certain such embodiments, the bridge connects the 2'-carbon and the 4'-carbon of the furanosyl.

As used herein, "nucleotide" means a nucleoside further comprising a phosphate linking group. As used herein, "linked nucleosides" may or may not be linked by phosphate linkages and thus includes, but is not limited to "linked nucleotides." As used herein, "linked nucleosides" are nucleosides that are connected in a continuous sequence (i.e. no additional nucleosides are present between those that are linked).

As used herein, "nucleobase" means a group of atoms that can be linked to a sugar moiety to create a nucleoside that is capable of incorporation into an oligonucleotide, and wherein the group of atoms is capable of bonding with a complementary naturally occurring nucleobase of another oligonucleotide or nucleic acid. Nucleobases may be naturally occurring or may be modified.

As used herein the terms, "unmodified nucleobase" or "naturally occurring nucleobase" means the naturally occurring heterocyclic nucleobases of RNA or DNA: the purine bases adenine (A) and guanine (G), and the pyrimidine bases thymine (T), cytosine (C) (including 5-methyl C), and uracil (U).

As used herein, "modified nucleobase" means any nucleobase that is not a naturally occurring nucleobase.

As used herein, "modified nucleoside" means a nucleoside comprising at least one chemical modification compared to naturally occurring RNA or DNA nucleosides. Modified nucleosides comprise a modified sugar moiety and/or a modified nucleobase.

As used herein, "bicyclic nucleoside" or "BNA" means a nucleoside comprising a bicyclic sugar moiety.

As used herein, "constrained ethyl nucleoside" or "cEt" means a nucleoside comprising a bicyclic sugar moiety comprising a 4'-CH(CH₃)—O-2'bridge.

As used herein, "locked nucleic acid nucleoside" or "LNA" means a nucleoside comprising a bicyclic sugar moiety comprising a 4'-CH₂—O-2'bridge.

As used herein, "2'-substituted nucleoside" means a nucleoside comprising a substituent at the 2'-position other than H or OH. Unless otherwise indicated, a 2'-substituted nucleoside is not a bicyclic nucleoside.

As used herein, "deoxynucleoside" means a nucleoside comprising 2'-H furanosyl sugar moiety, as found in naturally occurring deoxyribonucleosides (DNA). In certain embodiments, a 2'-deoxynucleoside may comprise a modified nucleobase or may comprise an RNA nucleobase (e.g., uracil).

As used herein, "oligonucleotide" means a compound comprising a plurality of linked nucleosides. In certain embodiments, an oligonucleotide comprises one or more unmodified ribonucleosides (RNA) and/or unmodified deoxyribonucleosides (DNA) and/or one or more modified nucleosides.

As used herein "oligonucleoside" means an oligonucleotide in which none of the internucleoside linkages contains a phosphorus atom. As used herein, oligonucleotides include oligonucleosides.

As used herein, "modified oligonucleotide" means an oligonucleotide comprising at least one modified nucleoside and/or at least one modified internucleoside linkage.

As used herein, "linkage" or "linking group" means a group of atoms that link together two or more other groups of atoms. In certain embodiments, a linking group links together a conjugate and a oligomer.

As used herein "internucleoside linkage" means a covalent linkage between adjacent nucleosides in an oligonucleotide.

As used herein "naturally occurring internucleoside linkage" means a 3' to 5' phosphodiester linkage.

As used herein, "modified internucleoside linkage" means any internucleoside linkage other than a naturally occurring internucleoside linkage.

As used herein, "terminal internucleoside linkage" means the linkage between the last two nucleosides of an oligonucleotide or defined region thereof.

As used herein, "phosphorus linking group" means a linking group comprising a phosphorus atom. Phosphorus linking groups include without limitation groups having the formula:

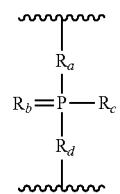

wherein:
$R_a$ and $R_d$ are each, independently, O, S, CH₂, NH, or NJ₁ wherein J₁ is $C_1$-$C_6$ alkyl or substituted $C_1$-$C_6$ alkyl;
$R_b$ is O or S;
$R_c$ is OH, SH, $C_1$-$C_6$ alkyl, substituted $C_1$-$C_6$ alkyl, $C_1$-$C_6$ alkoxy, substituted $C_1$-$C_6$ alkoxy, amino or substituted amino; and
J₁ is $R_b$ is O or S.

Phosphorus linking groups include without limitation, phosphodiester, phosphorothioate, phosphorodithioate, phosphonate, phosphoramidate, phosphorothioamidate, thionoalkylphosphonate, phosphotriesters, thionoalkylphosphotriester and boranophosphate.

As used herein, "internucleoside phosphorus linking group" means a phosphorus linking group that directly links two nucleosides.

As used herein, "non-internucleoside phosphorus linking group" means a phosphorus linking group that does not directly link two nucleosides. In certain embodiments, a non-internucleoside phosphorus linking group links a nucleoside to a group other than a nucleoside. In certain embodiments, a non-internucleoside phosphorus linking group links two groups, neither of which is a nucleoside.

As used herein, "neutral linking group" means a linking group that is not charged. Neutral linking groups include without limitation phosphotriesters, methylphosphonates, MMI (—CH₂—N(CH₃)—O—), amide-3 (—CH₂—C(═O)—N(H)—), amide-4 (—CH₂—N(H)—C(═O)—), formacetal (—O—CH₂—O—), and thioformacetal (—S—CH₂—O—). Further neutral linking groups include nonionic linkages comprising siloxane (dialkylsiloxane), carboxylate ester, carboxamide, sulfide, sulfonate ester and amides (See for example: Carbohydrate Modifications in Antisense Research; Y. S. Sanghvi and P. D. Cook Eds. ACS Symposium Series 580; Chapters 3 and 4, (pp. 40-65)). Further neutral linking groups include nonionic linkages comprising mixed N, O, S and CH₂ component parts.

As used herein, "internucleoside neutral linking group" means a neutral linking group that directly links two nucleosides.

As used herein, "non-internucleoside neutral linking group" means a neutral linking group that does not directly link two nucleosides. In certain embodiments, a non-internucleoside neutral linking group links a nucleoside to a group other than a nucleoside. In certain embodiments, a non-internucleoside neutral linking group links two groups, neither of which is a nucleoside.

As used herein, "oligomeric compound" means a polymeric structure comprising two or more sub-structures. In certain embodiments, an oligomeric compound comprises an oligonucleotide. In certain embodiments, an oligomeric compound comprises one or more conjugate groups and/or terminal groups. In certain embodiments, an oligomeric compound consists of an oligonucleotide. Oligomeric compounds also include naturally occurring nucleic acids. In certain embodiments, an oligomeric compound comprises a backbone of one or more linked monomeric subunits where each linked monomeric subunit is directly or indirectly attached to a heterocyclic base moiety. In certain embodiments, oligomeric compounds may also include monomeric subunits that are not linked to a heterocyclic base moiety, thereby providing abasic sites. In certain embodiments, the linkages joining the monomeric subunits, the sugar moieties or surrogates and the heterocyclic base moieties can be independently modified. In certain embodiments, the linkage-sugar unit, which may or may not include a heterocyclic base, may be substituted with a mimetic such as the monomers in peptide nucleic acids.

As used herein, "oligomer" means any compound that comprises at least two linked subunits. In certain embodiments, an oligomer comprises an oligonucleotide. In certain embodiments, an oligomer comprises a modified oligonucleotide. In certain embodiments, an oligomer consists of a modified oligonucleotide.

As used herein, "connecting group" means a bond or a group of atoms that link together two or more other groups of atoms. In certain embodiments, a connecting group links a ligand to a modified oligonucleotide. In certain embodiments, a connecting group comprises all or part of a linking group, a branching group, and/or a tether.

As used herein, "terminal group" means one or more atom attached to either, or both, the 3' end or the 5' end of an oligonucleotide. In certain embodiments a terminal group is a conjugate group. In certain embodiments, a terminal group comprises one or more terminal group nucleosides.

As used herein, "conjugate" or "conjugate group" means an atom or group of atoms bound to an oligonucleotide or oligomeric compound. In general, conjugate groups modify one or more properties of the compound to which they are attached, including, but not limited to pharmacodynamic, pharmacokinetic, binding, absorption, cellular distribution, cellular uptake, charge and/or clearance properties.

As used herein, "conjugate linker" or "linker" in the context of a conjugate group means a portion of a conjugate group comprising any atom or group of atoms and which covalently link (1) an oligonucleotide to another portion of the conjugate group or (2) two or more portions of the conjugate group.

Conjugate groups are shown herein as radicals, providing a bond for forming covalent attachment to an oligomeric compound such as an antisense oligonucleotide. In certain embodiments, the point of attachment on the oligomeric compound is the 3'-oxygen atom of the 3'-hydroxyl group of the 3' terminal nucleoside of the oligomeric compound. In certain embodiments the point of attachment on the oligomeric compound is the 5'-oxygen atom of the 5'-hydroxyl group of the 5' terminal nucleoside of the oligomeric compound. In certain embodiments, the bond for forming attachment to the oligomeric compound is a cleavable bond. In certain such embodiments, such cleavable bond constitutes all or part of a cleavable moiety.

In certain embodiments, conjugate groups comprise a cleavable moiety (e.g., a cleavable bond or cleavable nucleoside) and a carbohydrate cluster portion, such as a GalNAc cluster portion. Such carbohydrate cluster portion comprises: a targeting moiety and, optionally, a conjugate linker. In certain embodiments, the carbohydrate cluster portion is identified by the number and identity of the ligand. For example, in certain embodiments, the carbohydrate cluster portion comprises 3 GalNAc groups and is designated "GalNAc$_3$". In certain embodiments, the carbohydrate cluster portion comprises 4 GalNAc groups and is designated "GalNAc$_4$". Specific carbohydrate cluster portions (having specific tether, branching and conjugate linker groups) are described herein and designated by Roman numeral followed by subscript "a". Accordingly "GalNac3-1$_a$" refers to a specific carbohydrate cluster portion of a conjugate group having 3 GalNac groups and specifically identified tether, branching and linking groups. Such carbohydrate cluster fragment is attached to an oligomeric compound via a cleavable moiety, such as a cleavable bond or cleavable nucleoside.

As used herein, "cleavable moiety" means a bond or group that is capable of being cleaved under physiological conditions. In certain embodiments, a cleavable moiety is cleaved inside a cell or sub-cellular compartments, such as an endosome or lysosome. In certain embodiments, a cleavable moiety is cleaved by endogenous enzymes, such as nucleases. In certain embodiments, a cleavable moiety comprises a group of atoms having one, two, three, four, or more than four cleavable bonds. In certain embodiments, a cleavable moiety is a phosphodiester linkage.

As used herein, "cleavable bond" means any chemical bond capable of being broken. In certain embodiments, a cleavable bond is selected from among: an amide, a polyamide, an ester, an ether, one or both esters of a phosphodiester, a phosphate ester, a carbamate, a di-sulfide, or a peptide.

As used herein, "carbohydrate cluster" means a compound having one or more carbohydrate residues attached to a scaffold or linker group. (see, e.g., Maier et al., "Synthesis of Antisense Oligonucleotides Conjugated to a Multivalent Carbohydrate Cluster for Cellular Targeting," *Bioconjugate Chemistry*, 2003, (14): 18-29, which is incorporated herein by reference in its entirety, or Rensen et al., "Design and Synthesis of Novel N-Acetylgalactosamine-Terminated Glycolipids for Targeting of Lipoproteins to the Hepatic Asiaglycoprotein Receptor," *J. Med. Chem.* 2004, (47): 5798-5808, for examples of carbohydrate conjugate clusters).

As used herein, "modified carbohydrate" means any carbohydrate having one or more chemical modifications relative to naturally occurring carbohydrates.

As used herein, "carbohydrate derivative" means any compound which may be synthesized using a carbohydrate as a starting material or intermediate.

As used herein, "carbohydrate" means a naturally occurring carbohydrate, a modified carbohydrate, or a carbohydrate derivative.

As used herein "protecting group" means any compound or protecting group known to those having skill in the art. Non-limiting examples of protecting groups may be found in "Protective Groups in Organic Chemistry", T. W. Greene, P. G. M. Wuts, ISBN 0-471-62301-6, John Wiley & Sons, Inc, New York, which is incorporated herein by reference in its entirety.

As used herein, "single-stranded" means an oligomeric compound that is not hybridized to its complement and which lacks sufficient self-complementarity to form a stable self-duplex.

As used herein, "double stranded" means a pair of oligomeric compounds that are hybridized to one another or a single self-complementary oligomeric compound that forms a hairpin structure. In certain embodiments, a double-stranded oligomeric compound comprises a first and a second oligomeric compound.

As used herein, "antisense compound" means a compound comprising or consisting of an oligonucleotide at least a portion of which is complementary to a target nucleic acid to which it is capable of hybridizing, resulting in at least one antisense activity.

As used herein, "antisense activity" means any detectable and/or measurable change attributable to the hybridization of an antisense compound to its target nucleic acid. In certain embodiments, antisense activity includes modulation of the amount or activity of a target nucleic acid transcript (e.g. mRNA). In certain embodiments, antisense activity includes modulation of the splicing of pre-mRNA.

As used herein, "RNase H based antisense compound" means an antisense compound wherein at least some of the antisense activity of the antisense compound is attributable to hybridization of the antisense compound to a target nucleic acid and subsequent cleavage of the target nucleic acid by RNase H.

As used herein, "RISC based antisense compound" means an antisense compound wherein at least some of the antisense activity of the antisense compound is attributable to the RNA Induced Silencing Complex (RISC).

As used herein, "detecting" or "measuring" means that a test or assay for detecting or measuring is performed. Such detection and/or measuring may result in a value of zero. Thus, if a test for detection or measuring results in a finding of no activity (activity of zero), the step of detecting or measuring the activity has nevertheless been performed.

As used herein, "detectable and/or measureable activity" means a statistically significant activity that is not zero.

As used herein, "essentially unchanged" means little or no change in a particular parameter, particularly relative to another parameter which changes much more. In certain embodiments, a parameter is essentially unchanged when it changes less than 5%. In certain embodiments, a parameter is essentially unchanged if it changes less than two-fold while another parameter changes at least ten-fold. For example, in certain embodiments, an antisense activity is a change in the amount of a target nucleic acid. In certain such embodiments, the amount of a non-target nucleic acid is essentially unchanged if it changes much less than the target nucleic acid does, but the change need not be zero.

As used herein, "expression" means the process by which a gene ultimately results in a protein. Expression includes, but is not limited to, transcription, post-transcriptional modification (e.g., splicing, polyadenlyation, addition of 5'-cap), and translation.

As used herein, "target nucleic acid" means a nucleic acid molecule to which an antisense compound is intended to hybridize to result in a desired antisense activity. Antisense oligonucleotides have sufficient complementarity to their target nucleic acids to allow hybridization under physiological conditions.

As used herein, "nucleobase complementarity" or "complementarity" when in reference to nucleobases means a nucleobase that is capable of base pairing with another nucleobase. For example, in DNA, adenine (A) is complementary to thymine (T). For example, in RNA, adenine (A) is complementary to uracil (U). In certain embodiments, complementary nucleobase means a nucleobase of an antisense compound that is capable of base pairing with a nucleobase of its target nucleic acid. For example, if a nucleobase at a certain position of an antisense compound is capable of hydrogen bonding with a nucleobase at a certain position of a target nucleic acid, then the position of hydrogen bonding between the oligonucleotide and the target nucleic acid is considered to be complementary at that nucleobase pair. Nucleobases comprising certain modifications may maintain the ability to pair with a counterpart nucleobase and thus, are still capable of nucleobase complementarity.

As used herein, "non-complementary" in reference to nucleobases means a pair of nucleobases that do not form hydrogen bonds with one another.

As used herein, "complementary" in reference to oligomeric compounds (e.g., linked nucleosides, oligonucleotides, or nucleic acids) means the capacity of such oligomeric compounds or regions thereof to hybridize to another oligomeric compound or region thereof through nucleobase complementarity. Complementary oligomeric compounds need not have nucleobase complementarity at each nucleoside. Rather, some mismatches are tolerated. In certain embodiments, complementary oligomeric compounds or regions are complementary at 70% of the nucleobases (70% complementary). In certain embodiments, complementary oligomeric compounds or regions are 80% complementary. In certain embodiments, complementary oligomeric compounds or regions are 90% complementary. In certain embodiments, complementary oligomeric compounds or regions are 95% complementary. In certain embodiments, complementary oligomeric compounds or regions are 100% complementary.

As used herein, "mismatch" means a nucleobase of a first oligomeric compound that is not capable of pairing with a nucleobase at a corresponding position of a second oligomeric compound, when the first and second oligomeric compound are aligned. Either or both of the first and second oligomeric compounds may be oligonucleotides.

As used herein, "hybridization" means the pairing of complementary oligomeric compounds (e.g., an antisense compound and its target nucleic acid). While not limited to a particular mechanism, the most common mechanism of pairing involves hydrogen bonding, which may be Watson-Crick, Hoogsteen or reversed Hoogsteen hydrogen bonding, between complementary nucleobases.

As used herein, "specifically hybridizes" means the ability of an oligomeric compound to hybridize to one nucleic acid site with greater affinity than it hybridizes to another nucleic acid site.

As used herein, "fully complementary" in reference to an oligonucleotide or portion thereof means that each nucleobase of the oligonucleotide or portion thereof is capable of pairing with a nucleobase of a complementary nucleic acid or contiguous portion thereof. Thus, a fully complementary region comprises no mismatches or unhybridized nucleobases in either strand.

As used herein, "percent complementarity" means the percentage of nucleobases of an oligomeric compound that are complementary to an equal-length portion of a target nucleic acid. Percent complementarity is calculated by dividing the number of nucleobases of the oligomeric compound that are complementary to nucleobases at corresponding positions in the target nucleic acid by the total length of the oligomeric compound.

As used herein, "percent identity" means the number of nucleobases in a first nucleic acid that are the same type (independent of chemical modification) as nucleobases at corresponding positions in a second nucleic acid, divided by the total number of nucleobases in the first nucleic acid.

As used herein, "modulation" means a change of amount or quality of a molecule, function, or activity when compared to the amount or quality of a molecule, function, or activity prior to modulation. For example, modulation includes the change, either an increase (stimulation or induction) or a decrease (inhibition or reduction) in gene expression. As a further example, modulation of expression can include a change in splice site selection of pre-mRNA processing, resulting in a change in the absolute or relative amount of a particular splice-variant compared to the amount in the absence of modulation.

As used herein, "chemical motif" means a pattern of chemical modifications in an oligonucleotide or a region thereof. Motifs may be defined by modifications at certain nucleosides and/or at certain linking groups of an oligonucleotide.

As used herein, "nucleoside motif" means a pattern of nucleoside modifications in an oligonucleotide or a region thereof. The linkages of such an oligonucleotide may be modified or unmodified. Unless otherwise indicated, motifs herein describing only nucleosides are intended to be nucleoside motifs. Thus, in such instances, the linkages are not limited.

As used herein, "sugar motif" means a pattern of sugar modifications in an oligonucleotide or a region thereof.

As used herein, "linkage motif" means a pattern of linkage modifications in an oligonucleotide or region thereof. The nucleosides of such an oligonucleotide may be modified or unmodified. Unless otherwise indicated, motifs herein describing only linkages are intended to be linkage motifs. Thus, in such instances, the nucleosides are not limited.

As used herein, "nucleobase modification motif" means a pattern of modifications to nucleobases along an oligonucleotide. Unless otherwise indicated, a nucleobase modification motif is independent of the nucleobase sequence.

As used herein, "sequence motif" means a pattern of nucleobases arranged along an oligonucleotide or portion thereof. Unless otherwise indicated, a sequence motif is independent of chemical modifications and thus may have any combination of chemical modifications, including no chemical modifications.

As used herein, "type of modification" in reference to a nucleoside or a nucleoside of a "type" means the chemical modification of a nucleoside and includes modified and unmodified nucleosides. Accordingly, unless otherwise indicated, a "nucleoside having a modification of a first type" may be an unmodified nucleoside.

As used herein, "differently modified" mean chemical modifications or chemical substituents that are different from one another, including absence of modifications. Thus, for example, a MOE nucleoside and an unmodified DNA nucleoside are "differently modified," even though the DNA nucleoside is unmodified. Likewise, DNA and RNA are "differently modified," even though both are naturally-occurring unmodified nucleosides. Nucleosides that are the same but for comprising different nucleobases are not differently modified. For example, a nucleoside comprising a 2'-OMe modified sugar and an unmodified adenine nucleobase and a nucleoside comprising a 2'-OMe modified sugar and an unmodified thymine nucleobase are not differently modified.

As used herein, "the same type of modifications" refers to modifications that are the same as one another, including absence of modifications. Thus, for example, two unmodified DNA nucleosides have "the same type of modification," even though the DNA nucleoside is unmodified. Such nucleosides having the same type modification may comprise different nucleobases.

As used herein, "separate regions" means portions of an oligonucleotide wherein the chemical modifications or the motif of chemical modifications of any neighboring portions include at least one difference to allow the separate regions to be distinguished from one another.

As used herein, "pharmaceutically acceptable carrier or diluent" means any substance suitable for use in administering to an animal. In certain embodiments, a pharmaceutically acceptable carrier or diluent is sterile saline. In certain embodiments, such sterile saline is pharmaceutical grade saline.

As used herein the term "metabolic disorder" means a disease or condition principally characterized by dysregulation of metabolism—the complex set of chemical reactions associated with breakdown of food to produce energy.

As used herein, the term "cardiovascular disorder" means a disease or condition principally characterized by impaired function of the heart or blood vessels.

As used herein the term "mono or polycyclic ring system" is meant to include all ring systems selected from single or polycyclic radical ring systems wherein the rings are fused or linked and is meant to be inclusive of single and mixed ring systems individually selected from aliphatic, alicyclic, aryl, heteroaryl, aralkyl, arylalkyl, heterocyclic, heteroaryl, heteroaromatic and heteroarylalkyl. Such mono and poly cyclic structures can contain rings that each have the same level of saturation or each, independently, have varying degrees of saturation including fully saturated, partially saturated or fully unsaturated. Each ring can comprise ring atoms selected from C, N, O and S to give rise to heterocyclic rings as well as rings comprising only C ring atoms which can be present in a mixed motif such as for example benzimidazole wherein one ring has only carbon ring atoms and the fused ring has two nitrogen atoms. The mono or polycyclic ring system can be further substituted with substituent groups such as for example phthalimide which has two =O groups attached to one of the rings. Mono or polycyclic ring systems can be attached to parent molecules using various strategies such as directly through a ring atom, fused through multiple ring atoms, through a substituent group or through a bifunctional linking moiety.

As used herein, "prodrug" means an inactive or less active form of a compound which, when administered to a subject, is metabolized to form the active, or more active, compound (e.g., drug).

As used herein, "substituent" and "substituent group," means an atom or group that replaces the atom or group of a named parent compound. For example a substituent of a modified nucleoside is any atom or group that differs from the atom or group found in a naturally occurring nucleoside (e.g., a modified 2'-substuent is any atom or group at the 2'-position of a nucleoside other than H or OH). Substituent groups can be protected or unprotected. In certain embodiments, compounds of the present disclosure have substituents at one or at more than one position of the parent compound. Substituents may also be further substituted with other substituent groups and may be attached directly or via a linking group such as an alkyl or hydrocarbyl group to a parent compound.

Likewise, as used herein, "substituent" in reference to a chemical functional group means an atom or group of atoms that differs from the atom or a group of atoms normally present in the named functional group. In certain embodiments, a substituent replaces a hydrogen atom of the functional group (e.g., in certain embodiments, the substituent of a substituted methyl group is an atom or group other than hydrogen which replaces one of the hydrogen atoms of an unsubstituted methyl group). Unless otherwise indicated, groups amenable for use as substituents include without limitation, halogen, hydroxyl, alkyl, alkenyl, alkynyl, acyl (—C(O)$R_{aa}$), carboxyl (—C(O)O—$R_{aa}$), aliphatic groups, alicyclic groups, alkoxy, substituted oxy (—O—$R_{aa}$), aryl, aralkyl, heterocyclic radical, heteroaryl, heteroarylalkyl, amino (—N($R_{bb}$)($R_{cc}$)), imino (=$NR_{bb}$), amido (—C(O)N($R_{bb}$)($R_{cc}$) or —N($R_{bb}$)C(O)$R_{aa}$), azido (—$N_3$), nitro (—$NO_2$), cyano (—CN), carbamido (—OC(O)N($R_{bb}$)($R_{cc}$) or —N($R_{bb}$)C(O)O$R_{aa}$), ureido (—N($R_{bb}$)C(O)N($R_{bb}$)($R_{cc}$)), thioureido (—N($R_{bb}$)C(S)N($R_{bb}$)—($R_{cc}$)), guanidinyl (—N($R_{bb}$)C(=$NR_{bb}$)N($R_{bb}$)($R_{cc}$)), amidinyl (—C(=$NR_{bb}$)N($R_{bb}$)($R_{cc}$) or —N($R_{bb}$)C(=$NR_{bb}$)($R_{aa}$)), thiol (—$SR_{bb}$), sulfinyl (—S(O)$R_{bb}$), sulfonyl (—S(O)$_2 R_{bb}$) and sulfonamidyl (—S(O)$_2$N($R_{bb}$)($R_{cc}$) or —N($R_{bb}$)S—(O)$_2 R_{bb}$). Wherein each $R_{aa}$, $R_{bb}$ and $R_{cc}$ is, independently, H, an optionally linked chemical functional group or a further substituent group with a preferred list including without limitation, alkyl, alkenyl, alkynyl, aliphatic, alkoxy, acyl, aryl, aralkyl, heteroaryl, alicyclic, heterocyclic and heteroarylalkyl. Selected substituents within the compounds described herein are present to a recursive degree.

As used herein, "alkyl," as used herein, means a saturated straight or branched hydrocarbon radical containing up to twenty four carbon atoms. Examples of alkyl groups include without limitation, methyl, ethyl, propyl, butyl, isopropyl, n-hexyl, octyl, decyl, dodecyl and the like. Alkyl groups typically include from 1 to about 24 carbon atoms, more typically from 1 to about 12 carbon atoms ($C_1$-$C_{12}$ alkyl) with from 1 to about 6 carbon atoms being more preferred.

As used herein, "alkenyl," means a straight or branched hydrocarbon chain radical containing up to twenty four carbon atoms and having at least one carbon-carbon double bond. Examples of alkenyl groups include without limitation, ethenyl, propenyl, butenyl, 1-methyl-2-buten-1-yl, dienes such as 1,3-butadiene and the like. Alkenyl groups typically include from 2 to about 24 carbon atoms, more typically from 2 to about 12 carbon atoms with from 2 to about 6 carbon atoms being more preferred. Alkenyl groups as used herein may optionally include one or more further substituent groups.

As used herein, "alkynyl," means a straight or branched hydrocarbon radical containing up to twenty four carbon atoms and having at least one carbon-carbon triple bond. Examples of alkynyl groups include, without limitation, ethynyl, 1-propynyl, 1-butynyl, and the like. Alkynyl groups typically include from 2 to about 24 carbon atoms, more typically from 2 to about 12 carbon atoms with from 2 to about 6 carbon atoms being more preferred. Alkynyl groups as used herein may optionally include one or more further substituent groups.

As used herein, "acyl," means a radical formed by removal of a hydroxyl group from an organic acid and has the general Formula —C(O)—X where X is typically aliphatic, alicyclic or aromatic. Examples include aliphatic carbonyls, aromatic carbonyls, aliphatic sulfonyls, aromatic sulfinyls, aliphatic sulfinyls, aromatic phosphates, aliphatic phosphates and the like. Acyl groups as used herein may optionally include further substituent groups.

As used herein, "alicyclic" means a cyclic ring system wherein the ring is aliphatic. The ring system can comprise one or more rings wherein at least one ring is aliphatic. Preferred alicyclics include rings having from about 5 to about 9 carbon atoms in the ring. Alicyclic as used herein may optionally include further substituent groups.

As used herein, "aliphatic" means a straight or branched hydrocarbon radical containing up to twenty four carbon atoms wherein the saturation between any two carbon atoms is a single, double or triple bond. An aliphatic group preferably contains from 1 to about 24 carbon atoms, more typically from 1 to about 12 carbon atoms with from 1 to about 6 carbon atoms being more preferred. The straight or branched chain of an aliphatic group may be interrupted with one or more heteroatoms that include nitrogen, oxygen, sulfur and phosphorus. Such aliphatic groups interrupted by heteroatoms include without limitation, polyalkoxys, such as polyalkylene glycols, polyamines, and polyimines Aliphatic groups as used herein may optionally include further substituent groups.

As used herein, "alkoxy" means a radical formed between an alkyl group and an oxygen atom wherein the oxygen atom is used to attach the alkoxy group to a parent molecule. Examples of alkoxy groups include without limitation, methoxy, ethoxy, propoxy, isopropoxy, n-butoxy, sec-butoxy, tert-butoxy, n-pentoxy, neopentoxy, n-hexoxy and the like. Alkoxy groups as used herein may optionally include further substituent groups.

As used herein, "aminoalkyl" means an amino substituted $C_1$-$C_{12}$ alkyl radical. The alkyl portion of the radical forms a covalent bond with a parent molecule. The amino group can be located at any position and the aminoalkyl group can be substituted with a further substituent group at the alkyl and/or amino portions.

As used herein, "aralkyl" and "arylalkyl" mean an aromatic group that is covalently linked to a $C_1$-$C_{12}$ alkyl radical. The alkyl radical portion of the resulting aralkyl (or arylalkyl) group forms a covalent bond with a parent molecule. Examples include without limitation, benzyl, phenethyl and the like. Aralkyl groups as used herein may optionally include further substituent groups attached to the alkyl, the aryl or both groups that form the radical group.

As used herein, "aryl" and "aromatic" mean a mono- or polycyclic carbocyclic ring system radicals having one or more aromatic rings. Examples of aryl groups include without limitation, phenyl, naphthyl, tetrahydronaphthyl, indanyl, idenyl and the like. Preferred aryl ring systems have from about 5 to about 20 carbon atoms in one or more rings. Aryl groups as used herein may optionally include further substituent groups.

As used herein, "halo" and "halogen," mean an atom selected from fluorine, chlorine, bromine and iodine.

As used herein, "heteroaryl," and "heteroaromatic," mean a radical comprising a mono- or polycyclic aromatic ring, ring system or fused ring system wherein at least one of the rings is aromatic and includes one or more heteroatoms. Heteroaryl is also meant to include fused ring systems including systems where one or more of the fused rings contain no heteroatoms. Heteroaryl groups typically include one ring atom selected from sulfur, nitrogen or oxygen. Examples of heteroaryl groups include without limitation, pyridinyl, pyrazinyl, pyrimidinyl, pyrrolyl, pyrazolyl, imidazolyl, thiazolyl, oxazolyl, isooxazolyl, thiadiazolyl, oxadiazolyl, thiophenyl, furanyl, quinolinyl, isoquinolinyl, benzimidazolyl, benzooxazolyl, quinoxalinyl and the like. Heteroaryl radicals can be attached to a parent molecule directly or through a linking moiety such as an aliphatic group or hetero atom. Heteroaryl groups as used herein may optionally include further substituent groups.

As used herein, "conjugate compound" means any atoms, group of atoms, or group of linked atoms suitable for use as a conjugate group. In certain embodiments, conjugate compounds may possess or impart one or more properties, including, but not limited to pharmacodynamic, pharmacokinetic, binding, absorption, cellular distribution, cellular uptake, charge and/or clearance properties.

As used herein, unless otherwise indicated or modified, the term "double-stranded" refers to two separate oligomeric compounds that are hybridized to one another. Such double stranded compounds may have one or more or non-hybridizing nucleosides at one or both ends of one or both strands (overhangs) and/or one or more internal non-hybridizing nucleosides (mismatches) provided there is sufficient complementarity to maintain hybridization under physiologically relevant conditions.

B. Certain Compounds

In certain embodiments, the invention provides conjugated antisense compounds comprising antisense oligonucleoitdes and a conjugate.

a. Certain Antisense Oligonucleotides

In certain embodiments, the invention provides antisense oligonucleotides. Such antisense oligonucleotides comprise linked nucleosides, each nucleoside comprising a sugar moiety and a nucleobase. The structure of such antisense oligonucleotides may be considered in terms of chemical features (e.g., modifications and patterns of modifications) and nucleobase sequence (e.g., sequence of antisense oligonucleotide, idenity and sequence of target nucleic acid).

i. Certain Chemistry Features

In certain embodiments, antisense oligonucleotide comprise one or more modification. In certain such embodiments, antisense oligonucleotides comprise one or more modified nucleosides and/or modified internucleoside linkages. In certain embodiments, modified nucleosides comprise a modifed sugar moirty and/or modifed nucleobase.

1. Certain Sugar Moieties

In certain embodiments, compounds of the disclosure comprise one or more modifed nucleosides comprising a modifed sugar moiety. Such compounds comprising one or more sugar-modified nucleosides may have desirable properties, such as enhanced nuclease stability or increased binding affinity with a target nucleic acid relative to an oligonucleotide comprising only nucleosides comprising naturally occurring sugar moieties. In certain embodiments, modified sugar moieties are substitued sugar moieties. In certain embodiments, modified sugar moieties are sugar surrogates. Such sugar surrogates may comprise one or more substitutions corresponding to those of substituted sugar moieties.

In certain embodiments, modified sugar moieties are substituted sugar moieties comprising one or more non-bridging sugar substituent, including but not limited to substituents at the 2' and/or 5' positions. Examples of sugar substituents suitable for the 2'-position, include, but are not limited to: 2'-F, 2'-OCH$_3$ ("OMe" or "O-methyl"), and 2'-O(CH$_2$)$_2$OCH$_3$ ("MOE"). In certain embodiments, sugar substituents at the 2' position is selected from allyl, amino, azido, thio, O-allyl, O—C$_1$-C$_{10}$ alkyl, O—C$_1$-C$_{10}$ substituted alkyl; OCF$_3$, O(CH$_2$)$_2$SCH$_3$, O(CH$_2$)$_2$—O—N(Rm)(Rn), and O—CH$_2$—C(=O)—N(Rm)(Rn), where each Rm and Rn is, independently, H or substituted or unsubstituted C$_1$-C$_{10}$ alkyl. Examples of sugar substituents at the 5'-position, include, but are not limited to: 5'-methyl (R or S); 5'-vinyl, and 5'-methoxy. In certain embodiments, substituted sugars comprise more than one non-bridging sugar substituent, for example, 2'-F-5'-methyl sugar moieties (see, e.g., PCT International Application WO 2008/101157, for additional 5', 2'-bis substituted sugar moieties and nucleosides).

Nucleosides comprising 2'-substituted sugar moieties are referred to as 2'-substituted nucleosides. In certain embodiments, a 2'-substituted nucleoside comprises a 2'-substituent group selected from halo, allyl, amino, azido, SH, CN, OCN, CF$_3$, OCF$_3$, O, S, or N(R$_m$)-alkyl; O, S, or N(R$_m$)-alkenyl; O, S or N(R$_m$)-alkynyl; O-alkylenyl-O-alkyl, alkynyl, alkaryl, aralkyl, O-alkaryl, O-aralkyl, O(CH$_2$)$_2$SCH$_3$, O—(CH$_2$)$_2$—O—N(R$_m$)(R$_n$) or O—CH$_2$—C(=O)—N (R$_m$)(R$_n$), where each R$_m$ and R$_n$ is, independently, H, an amino protecting group or substituted or unsubstituted C$_1$-C$_{10}$ alkyl. These 2'-substituent groups can be further substituted with one or more substituent groups independently selected from hydroxyl, amino, alkoxy, carboxy, benzyl, phenyl, nitro (NO$_2$), thiol, thioalkoxy (S-alkyl), halogen, alkyl, aryl, alkenyl and alkynyl.

In certain embodiments, a 2'-substituted nucleoside comprises a 2'-substituent group selected from F, NH$_2$, N$_3$, OCF$_3$, O—CH$_3$, O(CH$_2$)$_3$NH$_2$, CH$_2$—CH—CH$_2$, O—CH$_2$—CH—CH$_2$, OCH$_2$CH$_2$OCH$_3$, O(CH$_2$)$_2$SCH$_3$, O—(CH$_2$)$_2$—O—N(R$_m$)(R$_n$), O(CH$_2$)$_2$O(CH$_2$)$_2$N(CH$_3$)$_2$, and N-substituted acetamide (O—CH$_2$—C(=O)—N(R$_m$)(R$_n$) where each R$_m$ and R$_n$ is, independently, H, an amino protecting group or substituted or unsubstituted C$_1$-C$_{10}$ alkyl.

In certain embodiments, a 2'-substituted nucleoside comprises a sugar moiety comprising a 2'-substituent group selected from F, OCF$_3$, O—CH$_3$, OCH$_2$CH$_2$OCH$_3$, O(CH$_2$)$_2$SCH$_3$, O—(CH$_2$)$_2$—O—N(CH$_3$)$_2$, —O(CH$_2$)$_2$O (CH$_2$)$_2$N(CH$_3$)$_2$, and O—CH$_2$—C(=O)—N(H)CH$_3$.

In certain embodiments, a 2'-substituted nucleoside comprises a sugar moiety comprising a 2'-substituent group selected from F, O—CH$_3$, and OCH$_2$CH$_2$OCH$_3$.

Certain modfied sugar moieties comprise a bridging sugar substituent that forms a second ring resulting in a bicyclic sugar moiety. In certain such embodiments, the bicyclic sugar moiety comprises a bridge between the 4' and the 2' furanose ring atoms. Examples of such 4' to 2' sugar substituents, include, but are not limited to: —[C(R$_a$)(R$_b$)]$_n$—, —[C(R$_a$)(R$_b$)]$_n$—O—, —C(R$_a$R$_b$)—N(R)—O— or, —C(R$_a$R$_b$)—O—N(R)—; 4'-CH$_2$-2', 4'—(CH$_2$)$_2$-2', 4'—(CH$_2$)$_3$-2'; 4'—(CH$_2$)—O-2' (LNA); 4'-(CH$_2$)—S-2; 4'—(CH$_2$)$_2$—O-2' (ENA); 4'-CH(CH$_3$)—O-2' (cEt) and 4'-CH (CH$_2$OCH$_3$)—O-2', and analogs thereof (see, e.g., U.S. Pat. No. 7,399,845, issued on Jul. 15, 2008); 4'-C(CH$_3$)(CH$_3$)—O-2' and analogs thereof, (see, e.g., WO2009/006478, published Jan. 8, 2009); 4'-CH$_2$—N(OCH$_3$)-2' and analogs thereof (see, e.g., WO2008/150729, published Dec. 11, 2008); 4'-CH$_2$—O—N(CH$_3$)-2' (see, e.g., US2004/0171570, published Sep. 2, 2004); 4'-CH$_2$—O—N(R)-2', and 4'-CH$_2$—N(R)—O-2'-, wherein each R is, independently, H, a protecting group, or C$_1$-C$_{12}$ alkyl; 4'-CH$_2$—N(R)—O-2', wherein R is H, C$_1$-C$_{12}$ alkyl, or a protecting group (see, U.S. Pat. No. 7,427,672, issued on Sep. 23, 2008); 4'-CH$_2$—C(H)(CH$_3$)-2' (see, e.g., Chattopadhyaya, et al., *J. Org. Chem.*, 2009, 74, 118-134); and 4'-CH$_2$—C(=CH$_2$)-2' and analogs thereof (see, published PCT International Application WO 2008/154401, published on Dec. 8, 2008).

In certain embodiments, such 4' to 2' bridges independently comprise from 1 to 4 linked groups independently selected from —[C(R$_a$)(R$_b$)]$_n$—, —C(R$_a$)=C(R$_b$)—, —C($R_a$)=N—, —C(=N$R_a$)—, —C(=O)—, —C(=S)—, —O—, —Si($R_a$)$_2$—, —S(=O)$_x$—, and —N($R_a$)—;

wherein:

x is 0, 1, or 2;

n is 1, 2, 3, or 4;

each $R_a$ and $R_b$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, $OJ_1$, $NJ_1J_2$, $SJ_1$, $N_3$, $COOJ_1$, acyl (C(=O)—H), substituted acyl, CN, sulfonyl (S(=O)$_2$-$J_1$), or sulfoxyl (S(=O)-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl, or a protecting group.

Nucleosides comprising bicyclic sugar moieties are referred to as bicyclic nucleosides or BNAs. Bicyclic nucleosides include, but are not limited to, (A) α-L-Methyleneoxy (4'-CH$_2$—O-2') BNA, (B) β-D-Methyleneoxy (4'-CH$_2$—O-2') BNA (also referred to as locked nucleic acid or LNA), (C) Ethyleneoxy (4'—(CH$_2$)$_2$—O-2') BNA, (D) Aminooxy (4'-CH$_2$—O—N(R)-2') BNA, (E) Oxyamino (4'-CH$_2$—N(R)—O-2') BNA, (F) Methyl(methyleneoxy) (4'-CH(CH$_3$)—O-2') BNA (also referred to as constrained ethyl or cEt), (G) methylene-thio (4'-CH$_2$—S-2') BNA, (H) methylene-amino (4'-CH2-N(R)-2') BNA, (I) methyl carbocyclic (4'-CH$_2$—CH(CH$_3$)-2') BNA, and (J) propylene carbocyclic (4'-(CH$_2$)$_3$-2') BNA as depicted below.

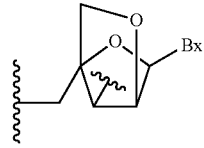

(A)

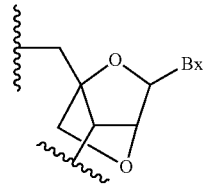

(B)

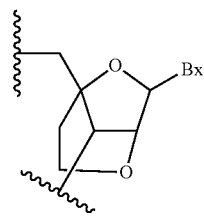

(C)

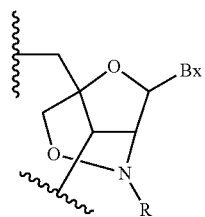

(D)

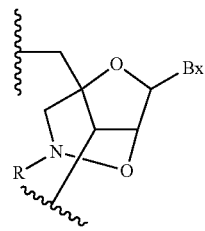

(E)

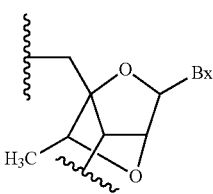

(F)

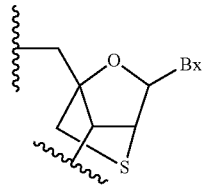

(G)

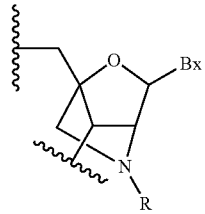

(H)

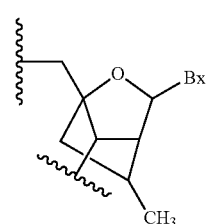

(I)

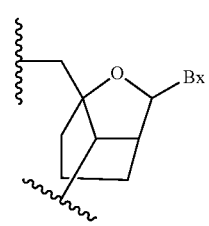

(J)

wherein Bx is a nucleobase moiety and R is, independently, H, a protecting group, or $C_1$-$C_{12}$ alkyl.

Additional bicyclic sugar moieties are known in the art, for example: Singh et al., *Chem. Commun.*, 1998, 4, 455-

456; Koshkin et al., *Tetrahedron*, 1998, 54, 3607-3630; Wahlestedt et al., *Proc. Natl. Acad. Sci. U.S.A.*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 129(26) 8362-8379 (Jul. 4, 2007); Elayadi et al., *Curr. Opinion Invens. Drugs*, 2001, 2, 558-561; Braasch et al., *Chem. Biol.*, 2001, 8, 1-7; Orum et al., *Curr. Opinion Mol. Ther.*, 2001, 3, 239-243; U.S. Pat. Nos. 7,053,207, 6,268,490, 6,770,748, 6,794,499, 7,034,133, 6,525,191, 6,670,461, and 7,399,845; WO 2004/106356, WO 1994/14226, WO 2005/021570, and WO 2007/134181; U.S. Patent Publication Nos. US2004/0171570, US2007/0287831, and US2008/0039618; U.S. patent Ser. Nos. 12/129,154, 60/989,574, 61/026,995, 61/026,998, 61/056,564, 61/086,231, 61/097,787, and 61/099,844; and PCT International Applications Nos. PCT/US2008/064591, PCT/US2008/066154, and PCT/US2008/068922.

In certain embodiments, bicyclic sugar moieties and nucleosides incorporating such bicyclic sugar moieties are further defined by isomeric configuration. For example, a nucleoside comprising a 4'-2' methylene-oxy bridge, may be in the α-L configuration or in the β-D configuration. Previously, α-L-methyleneoxy (4'-CH$_2$—O-2') bicyclic nucleosides have been incorporated into antisense oligonucleotides that showed antisense activity (Frieden et al., *Nucleic Acids Research*, 2003, 21, 6365-6372).

In certain embodiments, substituted sugar moieties comprise one or more non-bridging sugar substituent and one or more bridging sugar substituent (e.g., 5'-substituted and 4'-2' bridged sugars). (see, PCT International Application WO 2007/134181, published on Nov. 22, 2007, wherein LNA is substituted with, for example, a 5'-methyl or a 5'-vinyl group).

In certain embodiments, modified sugar moieties are sugar surrogates. In certain such embodiments, the oxygen atom of the naturally occuring sugar is substituted, e.g., with a sulfer, carbon or nitrogen atom. In certain such embodiments, such modified sugar moiety also comprises bridging and/or non-bridging substituents as described above. For example, certain sugar surrogates comprise a 4'-sulfer atom and a substitution at the 2'-position (see, e.g., published U.S. Patent Application US2005/0130923, published on Jun. 16, 2005) and/or the 5' position. By way of additional example, carbocyclic bicyclic nucleosides having a 4'-2' bridge have been described (see, e.g., Freier et al., *Nucleic Acids Research*, 1997, 25(22), 4429-4443 and Albaek et al., *J. Org. Chem.*, 2006, 71, 7731-7740).

In certain embodiments, sugar surrogates comprise rings having other than 5-atoms. For example, in certain embodiments, a sugar surrogate comprises a morphlino. Morpholino compounds and their use in oligomeric compounds has been reported in numerous patents and published articles (see for example: Braasch et al., *Biochemistry*, 2002, 41, 4503-4510; and U.S. Pat. Nos. 5,698,685; 5,166,315; 5,185,444; and 5,034,506). As used here, the term "morpholino" means a sugar surrogate having the following structure:

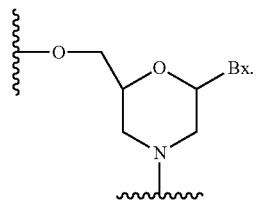

In certain embodiments, morpholinos may be modified, for example by adding or altering various substituent groups from the above morpholino structure. Such sugar surrogates are refered to herein as "modifed morpholinos."

For another example, in certain embodiments, a sugar surrogate comprises a six-membered tetrahydropyran. Such tetrahydropyrans may be further modified or substituted. Nucleosides comprising such modified tetrahydropyrans include, but are not limited to, hexitol nucleic acid (HNA), anitol nucleic acid (ANA), manitol nucleic acid (MNA) (see Leumann, C J. *Bioorg. & Med. Chem.* (2002) 10:841-854), fluoro HNA (F-HNA), and those compounds having Formula VI:

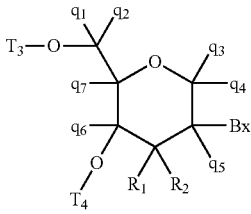

VI wherein independently for each of said at least one tetrahydropyran nucleoside analog of Formula VI:

Bx is a nucleobase moiety;

$T_3$ and $T_4$ are each, independently, an internucleoside linking group linking the tetrahydropyran nucleoside analog to the antisense compound or one of $T_3$ and $T_4$ is an internucleoside linking group linking the tetrahydropyran nucleoside analog to the antisense compound and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, the modified THP nucleosides of Formula VI are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, THP nucleosides of Formula VI are provided wherein one of $R_1$ and $R_2$ is F. In certain embodiments, $R_1$ is fluoro and $R_2$ is H, $R_1$ is methoxy and $R_2$ is H, and $R_1$ is methoxyethoxy and $R_2$ is H.

Many other bicyclo and tricyclo sugar surrogate ring systems are also known in the art that can be used to modify nucleosides for incorporation into antisense compounds (see, e.g., review article: Leumann, J. C, *Bioorganic & Medicinal Chemistry*, 2002, 10, 841-854).

Combinations of modifications are also provided without limitation, such as 2'-F-5'-methyl substituted nucleosides (see PCT International Application WO 2008/101157 Published on Aug. 21, 2008 for other disclosed 5', 2'-bis substituted nucleosides) and replacement of the ribosyl ring oxygen atom with S and further substitution at the 2'-position (see published U.S. Patent Application US2005-0130923, published on Jun. 16, 2005) or alternatively 5'-substitution of a bicyclic nucleic acid (see PCT International Application WO 2007/134181, published on Nov. 22, 2007 wherein a 4'-CH$_2$—O-2' bicyclic nucleoside is further substituted at the 5' position with a 5'-methyl or a 5'-vinyl group). The synthesis and preparation of carbocyclic bicyclic nucleosides along with their oligomerization and biochemical studies have also been described (see, e.g., Srivastava et al., *J. Am. Chem. Soc.* 2007, 129(26), 8362-8379).

In certain embodiments, the present disclosure provides oligonucleotides comprising modified nucleosides. Those modified nucleotides may include modified sugars, modified nucleobases, and/or modified linkages. The specific modifications are selected such that the resulting oligonucleotides possess desireable characteristics. In certain embodmiments, oligonucleotides comprise one or more RNA-like nucleosides. In certain embodiments, oligonucleotides comprise one or more DNA-like nucleotides.

2. Certain Nucleobase Modifications

In certain embodiments, nucleosides of the present disclosure comprise one or more unmodified nucleobases. In certain embodiments, nucleosides of the present disclosure comprise one or more modifed nucleobases.

In certain embodiments, modified nucleobases are selected from: universal bases, hydrophobic bases, promiscuous bases, size-expanded bases, and fluorinated bases as defined herein. 5-substituted pyrimidines, 6-azapyrimidines and N-2, N-6 and O-6 substituted purines, including 2-aminopropyladenine, 5-propynyluracil; 5-propynylcytosine; 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—CH$_3$) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine, 3-deazaguanine and 3-deazaadenine, universal bases, hydrophobic bases, promiscuous bases, size-expanded bases, and fluorinated bases as defined herein. Further modified nucleobases include tricyclic pyrimidines such as phenoxazine cytidine ([5,4-b][1,4]benzoxazin-2(3H)-one), phenothiazine cytidine (1H-pyrimido[5,4-b][1,4]benzothiazin-2(3H)-one), G-clamps such as a substituted phenoxazine cytidine (e.g. 9-(2-aminoethoxy)-H-pyrimido[5,4-b][1,4]benzoxazin-2(3H)-one), carbazole cytidine (2H-pyrimido[4,5-b]indol-2-one), pyridoindole cytidine (H-pyrido[3',2':4,5]pyrrolo[2,3-d]pyrimidin-2-one). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in U.S. Pat. No. 3,687,808, those disclosed in *The Concise Encyclopedia Of Polymer Science And Engineering*, Kroschwitz, J. I., Ed., John Wiley & Sons, 1990, 858-859; those disclosed by Englisch et al., *Angewandte Chemie*, International Edition, 1991, 30, 613; and those disclosed by Sanghvi, Y. S., Chapter 15, *Antisense Research and Applications*, Crooke, S. T. and Lebleu, B., Eds., CRC Press, 1993, 273-288.

Representative United States patents that teach the preparation of certain of the above noted modified nucleobases as well as other modified nucleobases include without limitation, U.S. Pat. Nos. 3,687,808; 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,645,985; 5,681,941; 5,750,692; 5,763,588; 5,830,653 and 6,005,096, certain of which are commonly owned with the instant application, and each of which is herein incorporated by reference in its entirety.

3. Certain Internucleoside Linkages

In certain embodiments, the present disclosure provides oligonucleotides comprising linked nucleosides. In such embodiments, nucleosides may be linked together using any internucleoside linkage. The two main classes of internucleoside linking groups are defined by the presence or absence of a phosphorus atom. Representative phosphorus containing internucleoside linkages include, but are not limited to, phosphodiesters (PO), phosphotriesters, methylphosphonates, phosphoramidate, and phosphorothioates (PS). Representative non-phosphorus containing internucleoside linking groups include, but are not limited to, methylenemethylimino (—CH$_2$—N(CH$_3$)—O—CH$_2$—), thiodiester (—O—C(O)—S—), thionocarbamate (—O—C(O)(NH)—S—); siloxane (—O—Si(H)$_2$—O—); and N,N'-dimethylhydrazine (—CH$_2$—N(CH$_3$)—N(CH$_3$)—). Modified linkages, compared to natural phosphodiester linkages, can be used to alter, typically increase, nuclease resistance of the oligonucleotide. In certain embodiments, internucleoside linkages having a chiral atom can be prepared as a racemic mixture, or as separate enantiomers. Representative chiral linkages include, but are not limited to, alkylphosphonates and phosphorothioates. Methods of preparation of phosphorous-containing and non-phosphorous-containing internucleoside linkages are well known to those skilled in the art.

The oligonucleotides described herein contain one or more asymmetric centers and thus give rise to enantiomers, diastereomers, and other stereoisomeric configurations that may be defined, in terms of absolute stereochemistry, as (R) or (S), α or β such as for sugar anomers, or as (D) or (L) such as for amino acids etc. Included in the antisense compounds provided herein are all such possible isomers, as well as their racemic and optically pure forms.

Neutral internucleoside linkages include without limitation, phosphotriesters, methylphosphonates, MMI (3'-CH$_2$—N(CH$_3$)—O-5'), amide-3 (3'-CH$_2$—C(=O)—N(H)-5'), amide-4 (3'-CH$_2$—N(H)—C(=O)-5'), formacetal (3'-O—CH$_2$—O-5'), and thioformacetal (3'-S—CH$_2$—O-5'). Further neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and CH$_2$ component parts.

4. Certain Motifs

In certain embodiments, antisense oligonucleotides comprise one or more modified nucleoside (e.g., nucleoside comprising a modified sugar and/or modified nucleobase) and/or one or more modified internucleoside linkage. The pattern of such modifications on an oligonucleotide is referred to herein as a motif. In certain embodiments, sugar, nucleobase, and linkage motifs are independent of one another.

a. Certain Sugar Motifs

In certain embodiments, oligonucleotides comprise one or more type of modified sugar moieties and/or naturally occurring sugar moieties arranged along an oligonucleotide or region thereof in a defined pattern or sugar modification motif Such motifs may include any of the sugar modifications discussed herein and/or other known sugar modifications.

In certain embodiments, the oligonucleotides comprise or consist of a region having a gapmer sugar motif, which comprises two external regions or "wings" and a central or internal region or "gap." The three regions of a gapmer sugar motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap. In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric sugar gapmer). In certain embodiments, the sugar motifs of the 5'-wing differs from the sugar motif of the 3'-wing (asymmetric sugar gapmer).

i. Certain 5'-Wings

In certain embodiments, the 5'-wing of a gapmer consists of 1 to 8 linked nucleosides. In certain embodiments, the 5'-wing of a gapmer consists of 1 to 7 linked nucleosides. In certain embodiments, the 5'-wing of a gapmer consists of 1 to 6 linked nucleosides. In certain embodiments, the 5'-wing of a gapmer consists of 1 to 5 linked nucleosides. In certain embodiments, the 5'-wing of a gapmer consists of 2 to 5 linked nucleosides. In certain embodiments, the 5'-wing of a gapmer consists of 3 to 5 linked nucleosides. In certain embodiments, the 5'-wing of a gapmer consists of 4 or 5 linked nucleosides. In certain embodiments, the 5'-wing of a gapmer consists of 1 to 4 linked nucleosides. In certain embodiments, the 5'-wing of a gapmer consists of 1 to 3 linked nucleosides. In certain embodiments, the 5'-wing of a gapmer consists of 1 or 2 linked nucleosides. In certain embodiments, the 5'-wing of a gapmer consists of 2 to 4 linked nucleosides. In certain embodiments, the 5'-wing of a gapmer consists of 2 or 3 linked nucleosides. In certain embodiments, the 5'-wing of a gapmer consists of 3 or 4 linked nucleosides. In certain embodiments, the 5'-wing of a gapmer consists of 1 nucleoside. In certain embodiments, the 5'-wing of a gapmer consists of 2 linked nucleosides. In certain embodiments, the 5'-wing of a gapmer consists of 3 linked nucleosides. In certain embodiments, the 5'-wing of a gapmer consists of 4 linked nucleosides. In certain embodiments, the 5'-wing of a gapmer consists of 5 linked nucleosides. In certain embodiments, the 5'-wing of a gapmer consists of 6 linked nucleosides.

In certain embodiments, the 5'-wing of a gapmer comprises at least one bicyclic nucleoside. In certain embodiments, the 5'-wing of a gapmer comprises at least two bicyclic nucleosides. In certain embodiments, the 5'-wing of a gapmer comprises at least three bicyclic nucleosides. In certain embodiments, the 5'-wing of a gapmer comprises at least four bicyclic nucleosides. In certain embodiments, the 5'-wing of a gapmer comprises at least one constrained ethyl nucleoside. In certain embodiments, the 5'-wing of a gapmer comprises at least one LNA nucleoside. In certain embodiments, each nucleoside of the 5'-wing of a gapmer is a bicyclic nucleoside. In certain embodiments, each nucleoside of the 5'-wing of a gapmer is a constrained ethyl nucleoside. In certain embodiments, each nucleoside of the 5'-wing of a gapmer is a LNA nucleoside.

In certain embodiments, the 5'-wing of a gapmer comprises at least one non-bicyclic modified nucleoside. In certain embodiments, the 5'-wing of a gapmer comprises at least one 2'-substituted nucleoside. In certain embodiments, the 5'-wing of a gapmer comprises at least one 2'-MOE nucleoside. In certain embodiments, the 5'-wing of a gapmer comprises at least one 2'-OMe nucleoside. In certain embodiments, each nucleoside of the 5'-wing of a gapmer is a non-bicyclic modified nucleoside. In certain embodiments, each nucleoside of the 5'-wing of a gapmer is a 2'-substituted nucleoside. In certain embodiments, each nucleoside of the 5'-wing of a gapmer is a 2'-MOE nucleoside. In certain embodiments, each nucleoside of the 5'-wing of a gapmer is a 2'-OMe nucleoside.

In certain embodiments, the 5'-wing of a gapmer comprises at least one 2'-deoxynucleoside. In certain embodiments, each nucleoside of the 5'-wing of a gapmer is a 2'-deoxynucleoside. In a certain embodiments, the 5'-wing of a gapmer comprises at least one ribonucleoside. In certain embodiments, each nucleoside of the 5'-wing of a gapmer is a ribonucleoside. In certain embodiments, one, more than one, or each of the nucleosides of the 5'-wing is an RNA-like nucleoside.

In certain embodiments, the 5'-wing of a gapmer comprises at least one bicyclic nucleoside and at least one non-bicyclic modified nucleoside. In certain embodiments, the 5'-wing of a gapmer comprises at least one bicyclic nucleoside and at least one 2'-substituted nucleoside. In certain embodiments, the 5'-wing of a gapmer comprises at least one bicyclic nucleoside and at least one 2'-MOE nucleoside. In certain embodiments, the 5'-wing of a gapmer comprises at least one bicyclic nucleoside and at least one 2'-OMe nucleoside. In certain embodiments, the 5'-wing of a gapmer comprises at least one bicyclic nucleoside and at least one 2'-deoxynucleoside.

In certain embodiments, the 5'-wing of a gapmer comprises at least one constrained ethyl nucleoside and at least one non-bicyclic modified nucleoside. In certain embodiments, the 5'-wing of a gapmer comprises at least one constrained ethyl nucleoside and at least one 2'-substituted nucleoside. In certain embodiments, the 5'-wing of a gapmer comprises at least one constrained ethyl nucleoside and at least one 2'-MOE nucleoside. In certain embodiments, the 5'-wing of a gapmer comprises at least one constrained ethyl nucleoside and at least one 2'-OMe nucleoside. In certain embodiments, the 5'-wing of a gapmer comprises at least one constrained ethyl nucleoside and at least one 2'-deoxynucleoside.

ii. Certain 3'-Wings

In certain embodiments, the 3'-wing of a gapmer consists of 1 to 8 linked nucleosides. In certain embodiments, the 3'-wing of a gapmer consists of 1 to 7 linked nucleosides. In certain embodiments, the 3'-wing of a gapmer consists of 1 to 6 linked nucleosides. In certain embodiments, the 3'-wing of a gapmer consists of 1 to 5 linked nucleosides. In certain embodiments, the 3'-wing of a gapmer consists of 2 to 5 linked nucleosides. In certain embodiments, the 3'-wing of a gapmer consists of 3 to 5 linked nucleosides. In certain embodiments, the 3'-wing of a gapmer consists of 4 or 5 linked nucleosides. In certain embodiments, the 3'-wing of a gapmer consists of 1 to 4 linked nucleosides. In certain embodiments, the 3'-wing of a gapmer consists of 1 to 3 linked nucleosides. In certain embodiments, the 3'-wing of a gapmer consists of 1 or 2 linked nucleosides. In certain embodiments, the 3'-wing of a gapmer consists of 2 to 4 linked nucleosides. In certain embodiments, the 3'-wing of a gapmer consists of 2 or 3 linked nucleosides. In certain embodiments, the 3'-wing of a gapmer consists of 3 or 4 linked nucleosides. In certain embodiments, the 3'-wing of a gapmer consists of 1 nucleoside. In certain embodiments, the 3'-wing of a gapmer consists of 2 linked nucleosides. In certain embodiments, the 3'-wing of a gapmer consists of 3 linked nucleosides. In certain embodiments, the 3'-wing of a gapmer consists of 4 linked nucleosides. In certain embodiments, the 3'-wing of a gapmer consists of 5 linked nucleosides. In certain embodiments, the 3'-wing of a gapmer consists of 6 linked nucleosides.

In certain embodiments, the 3'-wing of a gapmer comprises at least one bicyclic nucleoside. In certain embodiments, the 3'-wing of a gapmer comprises at least one constrained ethyl nucleoside. In certain embodiments, the 3'-wing of a gapmer comprises at least one LNA nucleoside. In certain embodiments, each nucleoside of the 3'-wing of a gapmer is a bicyclic nucleoside. In certain embodiments, each nucleoside of the 3'-wing of a gapmer is a constrained ethyl nucleoside. In certain embodiments, each nucleoside of the 3'-wing of a gapmer is a LNA nucleoside.

In certain embodiments, the 3'-wing of a gapmer comprises at least one non-bicyclic modified nucleoside. In certain embodiments, the 3'-wing of a gapmer comprises at least two non-bicyclic modified nucleosides. In certain embodiments, the 3'-wing of a gapmer comprises at least three non-bicyclic modified nucleosides. In certain embodiments, the 3'-wing of a gapmer comprises at least four non-bicyclic modified nucleosides. In certain embodiments, the 3'-wing of a gapmer comprises at least one 2'-substituted nucleoside. In certain embodiments, the 3'-wing of a gapmer comprises at least one 2'-MOE nucleoside. In certain embodiments, the 3'-wing of a gapmer comprises at least one 2'-OMe nucleoside. In certain embodiments, each nucleoside of the 3'-wing of a gapmer is a non-bicyclic modified nucleoside. In certain embodiments, each nucleoside of the 3'-wing of a gapmer is a 2'-substituted nucleoside. In certain embodiments, each nucleoside of the 3'-wing of a gapmer is a 2'-MOE nucleoside. In certain embodiments, each nucleoside of the 3'-wing of a gapmer is a 2'-OMe nucleoside.

In certain embodiments, the 3'-wing of a gapmer comprises at least one 2'-deoxynucleoside. In certain embodiments, each nucleoside of the 3'-wing of a gapmer is a 2'-deoxynucleoside. In a certain embodiments, the 3'-wing of a gapmer comprises at least one ribonucleoside. In certain embodiments, each nucleoside of the 3'-wing of a gapmer is a ribonucleoside. In certain embodiments, one, more than one, or each of the nucleosides of the 5'-wing is an RNA-like nucleoside.

In certain embodiments, the 3'-wing of a gapmer comprises at least one bicyclic nucleoside and at least one non-bicyclic modified nucleoside. In certain embodiments, the 3'-wing of a gapmer comprises at least one bicyclic nucleoside and at least one 2'-substituted nucleoside. In certain embodiments, the 3'-wing of a gapmer comprises at least one bicyclic nucleoside and at least one 2'-MOE nucleoside. In certain embodiments, the 3'-wing of a gapmer comprises at least one bicyclic nucleoside and at least one 2'-OMe nucleoside. In certain embodiments, the 3'-wing of a gapmer comprises at least one bicyclic nucleoside and at least one 2'-deoxynucleoside.

In certain embodiments, the 3'-wing of a gapmer comprises at least one constrained ethyl nucleoside and at least one non-bicyclic modified nucleoside. In certain embodiments, the 3'-wing of a gapmer comprises at least one constrained ethyl nucleoside and at least one 2'-substituted nucleoside. In certain embodiments, the 3'-wing of a gapmer comprises at least one constrained ethyl nucleoside and at least one 2'-MOE nucleoside. In certain embodiments, the 3'-wing of a gapmer comprises at least one constrained ethyl nucleoside and at least one 2'-OMe nucleoside. In certain embodiments, the 3'-wing of a gapmer comprises at least one constrained ethyl nucleoside and at least one 2'-deoxynucleoside.

In certain embodiments, the 3'-wing of a gapmer comprises at least one LNA nucleoside and at least one non-bicyclic modified nucleoside. In certain embodiments, the 3'-wing of a gapmer comprises at least one LNA nucleoside and at least one 2'-substituted nucleoside. In certain embodiments, the 3'-wing of a gapmer comprises at least one LNA nucleoside and at least one 2'-MOE nucleoside. In certain embodiments, the 3'-wing of a gapmer comprises at least one LNA nucleoside and at least one 2'-OMe nucleoside. In certain embodiments, the 3'-wing of a gapmer comprises at least one LNA nucleoside and at least one 2'-deoxynucleoside.

In certain embodiments, the 3'-wing of a gapmer comprises at least one bicyclic nucleoside, at least one non-bicyclic modified nucleoside, and at least one 2'-deoxynucleoside. In certain embodiments, the 3'-wing of a gapmer comprises at least one constrained ethyl nucleoside, at least one non-bicyclic modified nucleoside, and at least one 2'-deoxynucleoside. In certain embodiments, the 3'-wing of a gapmer comprises at least one LNA nucleoside, at least one non-bicyclic modified nucleoside, and at least one 2'-deoxynucleoside.

In certain embodiments, the 3'-wing of a gapmer comprises at least one bicyclic nucleoside, at least one 2'-substituted nucleoside, and at least one 2'-deoxynucleoside. In certain embodiments, the 3'-wing of a gapmer comprises at least one constrained ethyl nucleoside, at least one 2'-substituted nucleoside, and at least one 2'-deoxynucleoside. In certain embodiments, the 3'-wing of a gapmer comprises at least one LNA nucleoside, at least one 2'-substituted nucleoside, and at least one 2'-deoxynucleoside.

In certain embodiments, the 3'-wing of a gapmer comprises at least one bicyclic nucleoside, at least one 2'-MOE nucleoside, and at least one 2'-deoxynucleoside. In certain embodiments, the 3'-wing of a gapmer comprises at least one constrained ethyl nucleoside, at least one 2'-MOE nucleoside, and at least one 2'-deoxynucleoside. In certain embodiments, the 3'-wing of a gapmer comprises at least one LNA nucleoside, at least one 2'-MOE nucleoside, and at least one 2'-deoxynucleoside.

In certain embodiments, the 3'-wing of a gapmer comprises at least one bicyclic nucleoside, at least one 2'-OMe nucleoside, and at least one 2'-deoxynucleoside. In certain embodiments, the 3'-wing of a gapmer comprises at least one constrained ethyl nucleoside, at least one 2'-OMe nucleoside, and at least one 2'-deoxynucleoside. In certain embodiments, the 3'-wing of a gapmer comprises at least one LNA nucleoside, at least one 2'-OMe nucleoside, and at least one 2'-deoxynucleoside.

iii. Certain Central Regions (Gaps)

In certain embodiments, the gap of a gapmer consists of 6 to 20 linked nucleosides. In certain embodiments, the gap of a gapmer consists of 6 to 15 linked nucleosides. In certain embodiments, the gap of a gapmer consists of 6 to 12 linked nucleosides. In certain embodiments, the gap of a gapmer consists of 6 to 10 linked nucleosides. In certain embodiments, the gap of a gapmer consists of 6 to 9 linked nucleosides. In certain embodiments, the gap of a gapmer consists of 6 to 8 linked nucleosides. In certain embodiments, the gap of a gapmer consists of 6 or 7 linked nucleosides. In certain embodiments, the gap of a gapmer consists of 7 to 10 linked nucleosides. In certain embodiments, the gap of a gapmer consists of 7 to 9 linked nucleosides. In certain embodiments, the gap of a gapmer consists of 7 or 8 linked nucleosides. In certain embodiments, the gap of a gapmer consists of 8 to 10 linked nucleosides. In certain embodiments, the gap of a gapmer consists of 8 or 9 linked nucleosides. In certain embodiments, the gap of a gapmer consists of 6 linked nucleosides. In certain embodiments, the gap of a gapmer consists of 7 linked nucleosides. In certain embodiments, the gap of a gapmer consists of 8 linked nucleosides. In certain embodiments, the gap of a gapmer consists of 9 linked nucleosides. In certain embodiments, the gap of a gapmer consists of 10 linked nucleosides. In certain embodiments, the gap of a gapmer consists of 11 linked nucleosides. In certain embodiments, the gap of a gapmer consists of 12 linked nucleosides.

In certain embodiments, each nucleoside of the gap of a gapmer is a 2'-deoxynucleoside. In certain embodiments, the gap comprises one or more modified nucleosides. In certain embodiments, each nucleoside of the gap of a gapmer is a 2'-deoxynucleoside or is a modified nucleoside that is "DNA-like." In such embodiments, "DNA-like" means that the nucleoside has similar characteristics to DNA, such that a duplex comprising the gapmer and an RNA molecule is capable of activating RNase H. For example, under certain conditions, 2'-(ara)-F have been shown to support RNase H activation, and thus is DNA-like. In certain embodiments, one or more nucleosides of the gap of a gapmer is not a 2'-deoxynucleoside and is not DNA-like. In certain such embodiments, the gapmer nonetheless supports RNase H activation (e.g., by virtue of the number or placement of the non-DNA nucleosides).

In certain embodiments, gaps comprise a stretch of unmodified 2'-deoxynucleoside interrupted by one or more modified nucleosides, thus resulting in three sub-regions (two stretches of one or more 2'-deoxynucleosides and a stretch of one or more interrupting modified nucleosides). In certain embodiments, no stretch of unmodified 2'-deoxynucleosides is longer than 5, 6, or 7 nucleosides. In certain embodiments, such short stretches is achieved by using short gap regions. In certain embodiments, short stretches are achieved by interrupting a longer gap region.

In certain embodiments, the gap comprises one or more modified nucleosides. In certain embodiments, the gap comprises one or more modified nucleosides selected from among cEt, FHNA, LNA, and 2-thio-thymidine. In certain embodiments, the gap comprises one modified nucleoside. In certain embodiments, the gap comprises a 5'-substituted sugar moiety selected from among 5'-Me, and 5'-(R)-Me. In certain embodiments, the gap comprises two modified nucleosides. In certain embodiments, the gap comprises three modified nucleosides. In certain embodiments, the gap comprises four modified nucleosides. In certain embodiments, the gap comprises two or more modified nucleosides and each modified nucleoside is the same. In certain embodiments, the gap comprises two or more modified nucleosides and each modified nucleoside is different.

In certain embodiments, the gap comprises one or more modified linkages. In certain embodiments, the gap comprises one or more methyl phosphonate linkages. In certain embodiments the gap comprises two or more modified linkages. In certain embodiments, the gap comprises one or more modified linkages and one or more modified nucleosides. In certain embodiments, the gap comprises one modified linkage and one modified nucleoside. In certain embodiments, the gap comprises two modified linkages and two or more modified nucleosides.

b. Certain Internucleoside Linkage Motifs

In certain embodiments, oligonucleotides comprise modified internucleoside linkages arranged along the oligonucleotide or region thereof in a defined pattern or modified internucleoside linkage motif. In certain embodiments, oligonucleotides comprise a region having an alternating internucleoside linkage motif. In certain embodiments, oligonucleotides of the present disclosure comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate internucleoside linkages. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 7 phosphorothioate internucleoside linkages. In certain embodiments, the oligonucleotide comprises at least 8 phosphorothioate internucleoside linkages. In certain embodiments, the oligonucleotide comprises at least 9 phosphorothioate internucleoside linkages. In certain embodiments, the oligonucleotide comprises at least 10 phosphorothioate internucleoside linkages. In certain embodiments, the oligonucleotide comprises at least 11 phosphorothioate internucleoside linkages. In certain embodiments, the oligonucleotide comprises at least 12 phosphorothioate internucleoside linkages. In certain embodiments, the oligonucleotide comprises at least 13 phosphorothioate internucleoside linkages. In certain embodiments, the oligonucleotide comprises at least 14 phosphorothioate internucleoside linkages.

In certain embodiments, the oligonucleotide comprises at least one block of at least 6 consecutive phosphorothioate internucleoside linkages. In certain embodiments, the oligonucleotide comprises at least one block of at least 7 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 9 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide. In certain embodiments, the oligonucleotide comprises less than 15 phosphorothioate internucleoside linkages. In certain embodiments, the oligonucleotide comprises less than 14 phosphorothioate internucleoside linkages. In certain embodiments, the oligonucleotide comprises less than 13 phosphorothioate internucleoside linkages. In certain embodiments, the oligonucleotide comprises less than 12 phosphorothioate internucleoside linkages. In certain embodiments, the oligonucleotide comprises less than 11 phosphorothioate internucleoside linkages. In certain embodiments, the oligonucleotide comprises less than 10 phosphorothioate internucleoside linkages. In certain embodiments, the oligonucleotide comprises less than 9 phosphorothioate internucleoside linkages. In certain embodiments, the oligonucleotide comprises less than 8 phosphorothioate internucleoside linkages. In certain embodiments, the oligonucleotide comprises less than 7 phosphorothioate internucleoside linkages. In certain embodiments, the oligonucleotide comprises less than 6 phosphorothioate internucleoside linkages. In certain embodiments, the oligonucleotide comprises less than 5 phosphorothioate internucleoside linkages.

c. Certain Nucleobase Modification Motifs

In certain embodiments, oligonucleotides comprise chemical modifications to nucleobases arranged along the oligonucleotide or region thereof in a defined pattern or nucleobases modification motif. In certain such embodiments, nucleobase modifications are arranged in a gapped motif. In certain embodiments, nucleobase modifications are arranged in an alternating motif. In certain embodiments, each nucleobase is modified. In certain embodiments, none of the nucleobases is chemically modified.

In certain embodiments, oligonucleotides comprise a block of modified nucleobases. In certain such embodiments, the block is at the 3'-end of the oligonucleotide. In certain embodiments the block is within 3 nucleotides of the 3'-end of the oligonucleotide. In certain such embodiments, the block is at the 5'-end of the oligonucleotide. In certain embodiments the block is within 3 nucleotides of the 5'-end of the oligonucleotide.

In certain embodiments, nucleobase modifications are a function of the natural base at a particular position of an oligonucleotide. For example, in certain embodiments each purine or each pyrimidine in an oligonucleotide is modified. In certain embodiments, each adenine is modified. In certain embodiments, each guanine is modified. In certain embodiments, each thymine is modified. In certain embodiments, each cytosine is modified. In certain embodiments, each uracil is modified.

In certain embodiments, some, all, or none of the cytosine moieties in an oligonucleotide are 5-methyl cytosine moieties. Herein, 5-methyl cytosine is not a "modified nucleobase." Accordingly, unless otherwise indicated, unmodified nucleobases include both cytosine residues having a 5-methyl and those lacking a 5 methyl. In certain embodiments, the methylation state of all or some cytosine nucleobases is specified.

In certain embodiments, chemical modifications to nucleobases comprise attachment of certain conjugate groups to nucleobases. In certain embodiments, each purine or each pyrimidine in an oligonucleotide may be optionally modified to comprise a conjugate group.

d. Certain Overall Lengths

In certain embodiments, the present disclosure provides oligonucleotides of any of a variety of ranges of lengths. In certain embodiments, oligonucleotides consist of X to Y linked nucleosides, where X represents the fewest number of nucleosides in the range and Y represents the largest number of nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X<Y. For example, in certain embodiments, the oligonucleotide may consist of 8 to 9, 8 to 10, 8 to 11, 8 to 12, 8 to 13, 8 to 14, 8 to 15, 8 to 16, 8 to 17, 8 to 18, 8 to 19, 8 to 20, 8 to 21, 8 to 22, 8 to 23, 8 to 24, 8 to 25, 8 to 26, 8 to 27, 8 to 28, 8 to 29, 8 to 30, 9 to 10, 9 to 11, 9 to 12, 9 to 13, 9 to 14, 9 to 15, 9 to 16, 9 to 17, 9 to 18, 9 to 19, 9 to 20, 9 to 21, 9 to 22, 9 to 23, 9 to 24, 9 to 25, 9 to 26, 9 to 27, 9 to 28, 9 to 29, 9 to 30, 10 to 11, 10 to 12, 10 to 13, 10 to 14, 10 to 15, 10 to 16, 10 to 17, 10 to 18, 10 to 19, 10 to 20, 10 to 21, 10 to 22, 10 to 23, 10 to 24, 10 to 25, 10 to 26, 10 to 27, 10 to 28, 10 to 29, 10 to 30, 11 to 12, 11 to 13, 11 to 14, 11 to 15, 11 to 16, 11 to 17, 11 to 18, 11 to 19, 11 to 20, 11 to 21, 11 to 22, 11 to 23, 11 to 24, 11 to 25, 11 to 26, 11 to 27, 11 to 28, 11 to 29, 11 to 30, 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides. In embodiments where the number of nucleosides of an oligonucleotide of a compound is limited, whether to a range or to a specific number, the compound may, nonetheless further comprise additional other substituents. For example, an oligonucleotide comprising 8-30 nucleosides excludes oligonucleotides having 31 nucleosides, but, unless otherwise indicated, such an oligonucleotide may further comprise, for example one or more conjugate groups, terminal groups, or other substituents.

Further, where an oligonucleotide is described by an overall length range and by regions having specified lengths, and where the sum of specified lengths of the regions is less than the upper limit of the overall length range, the oligonucleotide may have additional nucleosides, beyond those of the specified regions, provided that the total number of nucleosides does not exceed the upper limit of the overall length range.

5. Certain Antisense Oligonucleotide Chemistry Motifs

In certain embodiments, the chemical structural features of antisense oligonucleotides are characterized by their sugar motif, internucleoside linkage motif, nucleobase modification motif and overall length. In certain embodiments, such parameters are each independent of one another. Thus, each internucleoside linkage of an oligonucleotide having a gapmer sugar motif may be modified or unmodified and may or may not follow the gapmer modification pattern of the sugar modifications. Thus, the internucleoside linkages within the wing regions of a sugar-gapmer may be the same or different from one another and may be the same or different from the internucleoside linkages of the gap region. Likewise, such sugar-gapmer oligonucleotides may comprise one or more modified nucleobase independent of the gapmer pattern of the sugar modifications. One of skill in the art will appreciate that such motifs may be combined to create a variety of oligonucleotides.

In certain embodiments, the selection of internucleoside linkage and nucleoside modification are not independent of one another.

i. Certain Sequences and Targets

In certain embodiments, the invention provides antisense oligonucleotides having a sequence complementary to a target nucleic acid. Such antisense compounds are capable of hybridizing to a target nucleic acid, resulting in at least one antisense activity. In certain embodiments, antisense compounds specifically hybridize to one or more target nucleic acid. In certain embodiments, a specifically hybridizing antisense compound has a nucleobase sequence comprising a region having sufficient complementarity to a target nucleic acid to allow hybridization and result in antisense activity and insufficient complementarity to any non-target so as to avoid or reduce non-specific hybridization to non-target nucleic acid sequences under conditions in which specific hybridization is desired (e.g., under physiological conditions for in vivo or therapeutic uses, and under conditions in which assays are performed in the case of in vitro assays). In certain embodiments, oligonucleotides are selective between a target and non-target, even though both target and non-target comprise the target sequence. In such embodiments, selectivity may result from relative accessibility of the target region of one nucleic acid molecule compared to the other.

In certain embodiments, the present disclosure provides antisense compounds comprising oligonucleotides that are fully complementary to the target nucleic acid over the entire length of the oligonucleotide. In certain embodiments, oligonucleotides are 99% complementary to the target nucleic acid. In certain embodiments, oligonucleotides are 95% complementary to the target nucleic acid. In certain embodiments, such oligonucleotides are 90% complementary to the target nucleic acid.

In certain embodiments, such oligonucleotides are 85% complementary to the target nucleic acid. In certain embodiments, such oligonucleotides are 80% complementary to the target nucleic acid. In certain embodiments, an antisense compound comprises a region that is fully complementary to a target nucleic acid and is at least 80% complementary to the target nucleic acid over the entire length of the oligonucleotide. In certain such embodiments, the region of full complementarity is from 6 to 14 nucleobases in length.

In certain embodiments, oligonucleotides comprise a hybridizing region and a terminal region. In certain such embodiments, the hybridizing region consists of 12-30 linked nucleosides and is fully complementary to the target nucleic acid. In certain embodiments, the hybridizing region includes one mismatch relative to the target nucleic acid. In certain embodiments, the hybridizing region includes two mismatches relative to the target nucleic acid. In certain embodiments, the hybridizing region includes three mismatches relative to the target nucleic acid. In certain embodiments, the terminal region consists of 1-4 terminal nucleosides. In certain embodiments, the terminal nucleosides are at the 3' end. In certain embodiments, one or more of the terminal nucleosides are not complementary to the target nucleic acid.

Antisense mechanisms include any mechanism involving the hybridization of an oligonucleotide with target nucleic acid, wherein the hybridization results in a biological effect. In certain embodiments, such hybridization results in either target nucleic acid degradation or occupancy with concomitant inhibition or stimulation of the cellular machinery involving, for example, translation, transcription, or splicing of the target nucleic acid.

One type of antisense mechanism involving degradation of target RNA is RNase H mediated antisense. RNase H is a cellular endonuclease which cleaves the RNA strand of an RNA:DNA duplex. It is known in the art that single-stranded antisense compounds which are "DNA-like" elicit RNase H activity in mammalian cells. Activation of RNase H, therefore, results in cleavage of the RNA target, thereby greatly enhancing the efficiency of DNA-like oligonucleotide-mediated inhibition of gene expression.

In certain embodiments, a conjugate group comprises a cleavable moiety. In certain embodiments, a conjugate group comprises one or more cleavable bond. In certain embodiments, a conjugate group comprises a linker. In certain embodiments, a linker comprises a protein binding moiety. In certain embodiments, a conjugate group comprises a cell-targeting moiety (also referred to as a cell-targeting group). In certain embodiments a cell-targeting moiety comprises a branching group. In certain embodiments, a cell-targeting moiety comprises one or more tethers. In certain embodiments, a cell-targeting moiety comprises a carbohydrate or carbohydrate cluster.

ii. Certain Connecting Groups

In certain embodiments, one or more conjugates are attached to an oligomeric compound through a connecting group. In certain embodiments, a connecting group includes a tether or a portion of a tether. In certain embodiments, a connecting group includes a branching group or a portion of a branching group. In certain embodiments, a connecting group includes a linking group or a portion of a linking group. In certain embodiments, a connecting group includes a cleavable moiety or a portion of a cleavable moiety. In certain embodiments, a connecting group includes a tether, a branching group, and/or a linking group or a portion of a tether, a branching group, and/or a linking group.

In certain embodiments, a connecting group includes a tether and a branching group. In certain embodiments, a connecting group includes a portion of a tether and branching group. In certain embodiments, a connecting group includes a tether and portion of a branching group. In certain embodiments, a connecting group includes or a portion of a tether and portion of a branching group.

In certain embodiments, a connecting group includes a tether and a linking group. In certain embodiments, a connecting group includes a portion of a tether and linking group. In certain embodiments, a connecting group includes a tether and portion of a linking group. In certain embodiments, a connecting group includes a portion of a tether and portion of a linking group.

In certain embodiments, a connecting group includes a branching group and a linking group. In certain embodiments, a connecting group includes a portion of a branching group and linking group. In certain embodiments, a connecting group includes a branching group and portion of a linking group. In certain embodiments, a connecting group includes a portion of a branching group and portion of a linking group.

i. Certain Tethers

In certain embodiments, conjugate groups comprise one or more tethers covalently attached to the branching group.

In certain embodiments, conjugate groups comprise one or more tethers covalently attached to the linking group. In certain embodiments, each tether is a linear aliphatic group comprising one or more groups selected from alkyl, ether, thioether, disulfide, amide and polyethylene glycol groups in any combination. In certain embodiments, each tether is a linear aliphatic group comprising one or more groups selected from alkyl, substituted alkyl, ether, thioether, disulfide, amide, phosphodiester and polyethylene glycol groups in any combination. In certain embodiments, each tether is a linear aliphatic group comprising one or more groups selected from alkyl, ether and amide groups in any combination. In certain embodiments, each tether is a linear aliphatic group comprising one or more groups selected from alkyl, substituted alkyl, phosphodiester, ether and amide groups in any combination. In certain embodiments, each tether is a linear aliphatic group comprising one or more groups selected from alkyl and phosphodiester in any combination. In certain embodiments, each tether comprises at least one phosphorus linking group or neutral linking group.

In certain embodiments, the tether includes one or more cleavable bond. In certain embodiments, the tether is attached to the branching group through either an amide or an ether group. In certain embodiments, the tether is attached to the branching group through a phosphodiester group. In certain embodiments, the tether is attached to the branching group through a phosphorus linking group or neutral linking group. In certain embodiments, the tether is attached to the branching group through an ether group. In certain embodiments, the tether is attached to the ligand through either an amide or an ether group. In certain embodiments, the tether is attached to the ligand through an ether group. In certain embodiments, the tether is attached to the ligand through either an amide or an ether group. In certain embodiments, the tether is attached to the ligand through an ether group.

In certain embodiments, each tether comprises from about 8 to about 20 atoms in chain length between the ligand and the branching group. In certain embodiments, each tether group comprises from about 10 to about 18 atoms in chain length between the ligand and the branching group. In certain embodiments, each tether group comprises about 13 atoms in chain length.

In certain embodiments, a tether has a structure selected from among:

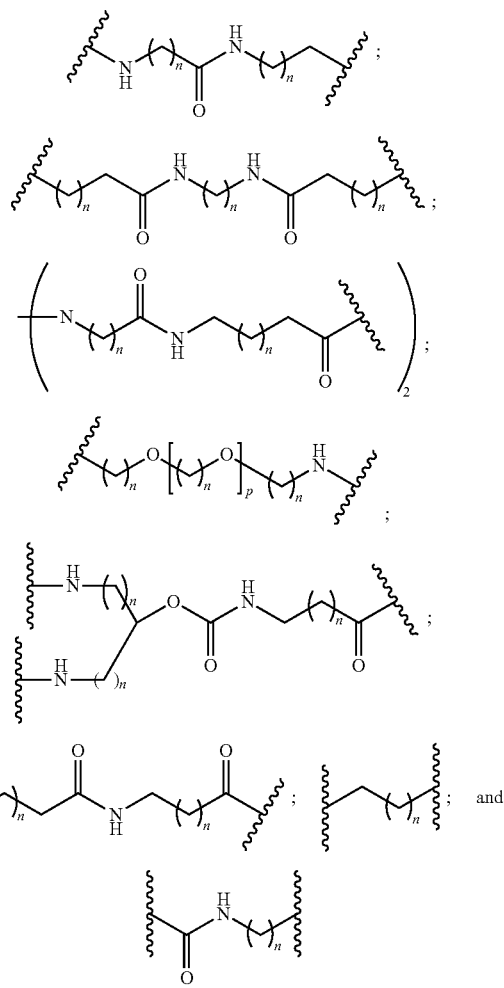

wherein each n is, independently, from 1 to 20; and
each p is from 1 to about 6.

In certain embodiments, a tether has a structure selected from among:

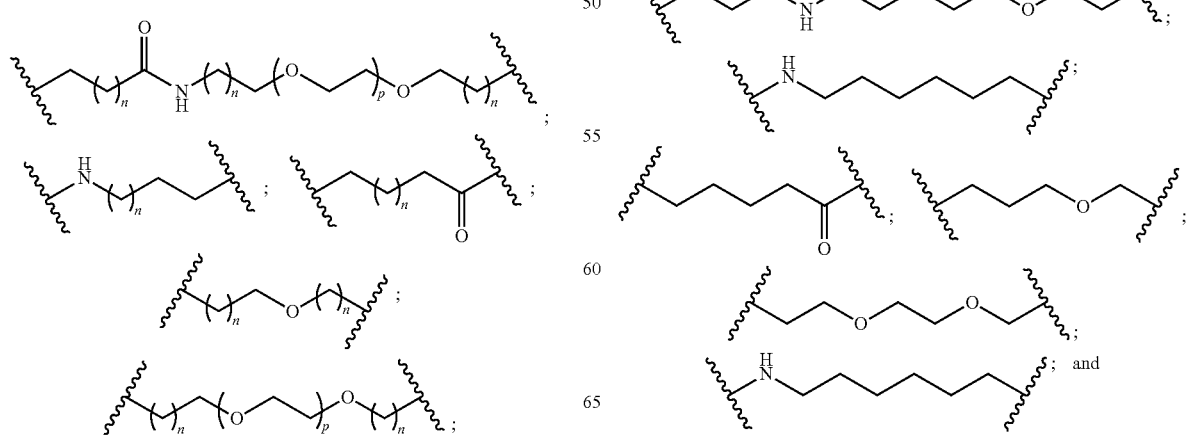

-continued

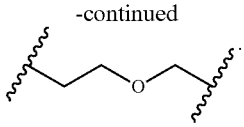

In certain embodiments, a tether has a structure selected from among:

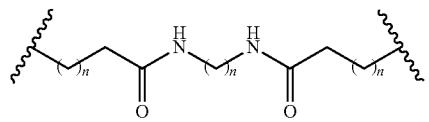

wherein each n is, independently, from 1 to 20.

In certain embodiments, a tether has a structure selected from among:

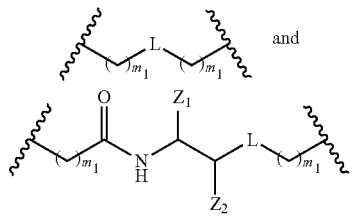

wherein L is either a phosphorus linking group or a neutral linking group;
$Z_1$ is $C(=O)O-R_2$;
$Z_2$ is H, $C_1$-$C_6$ alkyl or substituted $C_1$-$C_6$ alky;
$R_2$ is H, $C_1$-$C_6$ alkyl or substituted $C_1$-$C_6$ alky; and
each $m_1$ is, independently, from 0 to 20 wherein at least one $m_1$ is greater than 0 for each tether.

In certain embodiments, a tether has a structure selected from among:

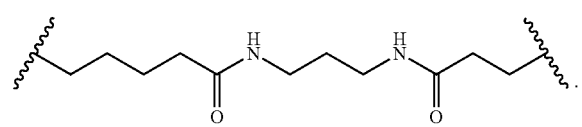 [SMILES: *CCCCC(=O)NCCCNC(=O)CC*]

In certain embodiments, a tether has a structure selected from among:

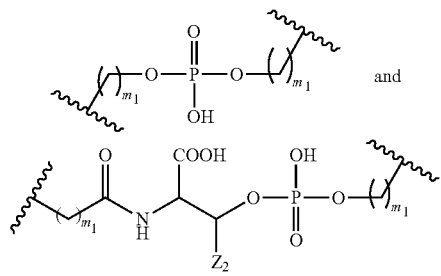

wherein $Z_2$ is H or $CH_3$; and
each $m_1$ is, independently, from 0 to 20 wherein at least one $m_1$ is greater than 0 for each tether.

In certain embodiments, a tether has a structure selected from among:

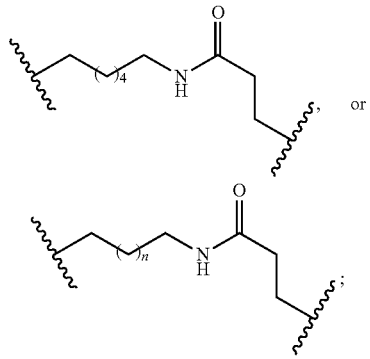

wherein each n is independently, 0, 1, 2, 3, 4, 5, 6, or 7.

In certain embodiments, a tether comprises a phosphorus linking group. In certain embodiments, a tether does not comprise any amide bonds. In certain embodiments, a tether comprises a phosphorus linking group and does not comprise any amide bonds.

ii. Certain Linking Groups

In certain embodiments, the conjugate groups comprise a linking group. In certain such embodiments, the linking group is covalently bound to the cleavable moiety. In certain such embodiments, the linking group is covalently bound to the antisense oligonucleotide. In certain embodiments, the linking group is covalently bound to a cell-targeting moiety. In certain embodiments, the linking group further comprises a covalent attachment to a solid support. In certain embodiments, the linking group further comprises a covalent attachment to a protein binding moiety. In certain embodiments, the linking group further comprises a covalent attachment to a solid support and further comprises a covalent attachment to a protein binding moiety. In certain embodiments, the linking group includes multiple positions for attachment of tethered ligands. In certain embodiments, the linking group includes multiple positions for attachment of tethered ligands and is not attached to a branching group. In certain embodiments, the linking group further comprises one or more cleavable bond. In certain embodiments, the conjugate group does not include a linking group.

In certain embodiments, the linking group includes at least a linear group comprising groups selected from alkyl, amide, disulfide, polyethylene glycol, ether, thioether (—S—) and hydroxylamino (—O—N(H)—) groups. In certain embodiments, the linear group comprises groups selected from alkyl, amide and ether groups. In certain embodiments, the linear group comprises groups selected from alkyl and ether groups. In certain embodiments, the linear group comprises at least one phosphorus linking group. In certain embodiments, the linear group comprises at least one phosphodiester group. In certain embodiments, the linear group includes at least one neutral linking group. In certain embodiments, the linear group is covalently attached to the cell-targeting moiety and the cleavable moiety. In certain embodiments, the linear group is covalently attached to the cell-targeting moiety and the antisense oligonucleotide. In certain embodiments, the linear group is covalently attached to the cell-targeting moiety, the cleavable moiety and a solid support. In certain embodiments, the linear group is covalently attached to the cell-targeting moiety, the cleavable moiety, a solid support and a protein binding moiety. In certain embodiments, the linear group includes one or more cleavable bond.

In certain embodiments, the linking group includes the linear group covalently attached to a scaffold group. In certain embodiments, the scaffold includes a branched aliphatic group comprising groups selected from alkyl, amide, disulfide, polyethylene glycol, ether, thioether and hydroxylamino groups. In certain embodiments, the scaffold includes a branched aliphatic group comprising groups selected from alkyl, amide and ether groups. In certain embodiments, the scaffold includes at least one mono or polycyclic ring system. In certain embodiments, the scaffold includes at least two mono or polycyclic ring systems. In certain embodiments, the linear group is covalently attached to the scaffold group and the scaffold group is covalently attached to the cleavable moiety and the linking group. In certain embodiments, the linear group is covalently attached to the scaffold group and the scaffold group is covalently attached to the cleavable moiety, the linking group and a solid support. In certain embodiments, the linear group is covalently attached to the scaffold group and the scaffold group is covalently attached to the cleavable moiety, the linking group and a protein binding moiety. In certain embodiments, the linear group is covalently attached to the scaffold group and the scaffold group is covalently attached to the cleavable moiety, the linking group, a protein binding moiety and a solid support. In certain embodiments, the scaffold group includes one or more cleavable bond.

In certain embodiments, the linking group includes a protein binding moiety. In certain embodiments, the protein binding moiety is a lipid such as for example including but not limited to cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl)lithocholic acid, O3-(oleoyl)cholenic acid, dimethoxytrityl, or phenoxazine), a vitamin (e.g., folate, vitamin A, vitamin E, biotin, pyridoxal), a peptide, a carbohydrate (e.g., monosaccharide, disaccharide, trisaccharide, tetrasaccharide, oligosaccharide, polysaccharide), an endosomolytic component, a steroid (e.g., uvaol, hecigenin, diosgenin), a terpene (e.g., triterpene, e.g., sarsasapogenin, friedelin, epifriedelanol derivatized lithocholic acid), or a cationic lipid. In certain embodiments, the protein binding moiety is a C16 to C22 long chain saturated or unsaturated fatty acid, cholesterol, cholic acid, vitamin E, adamantane or 1-pentafluoropropyl.

In certain embodiments, a linking group has a structure selected from among:

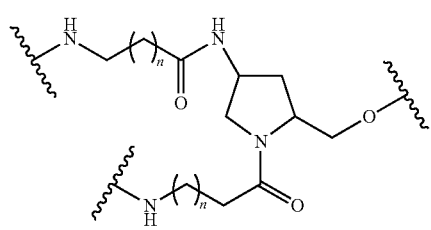

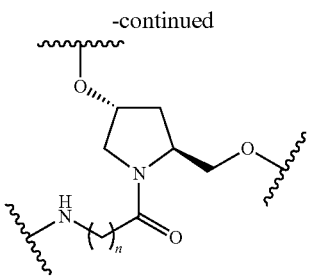

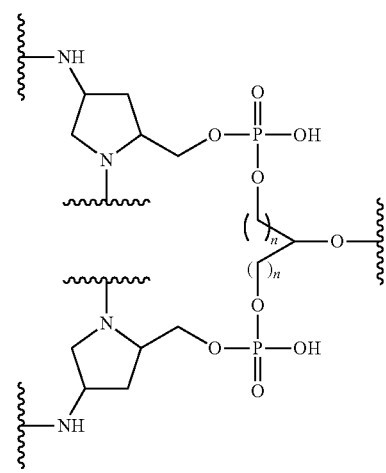

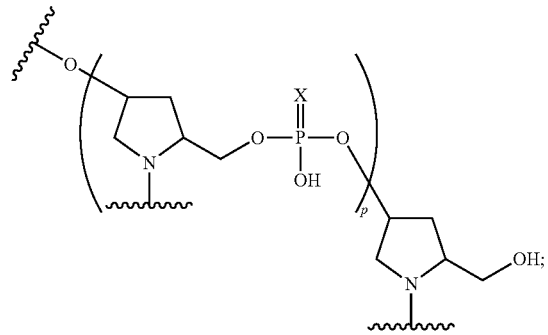

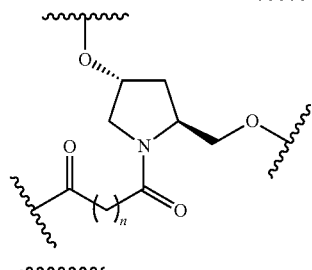

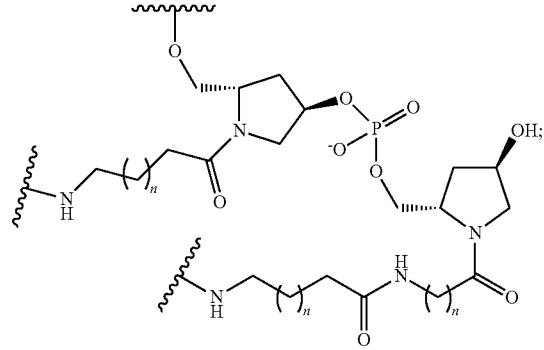

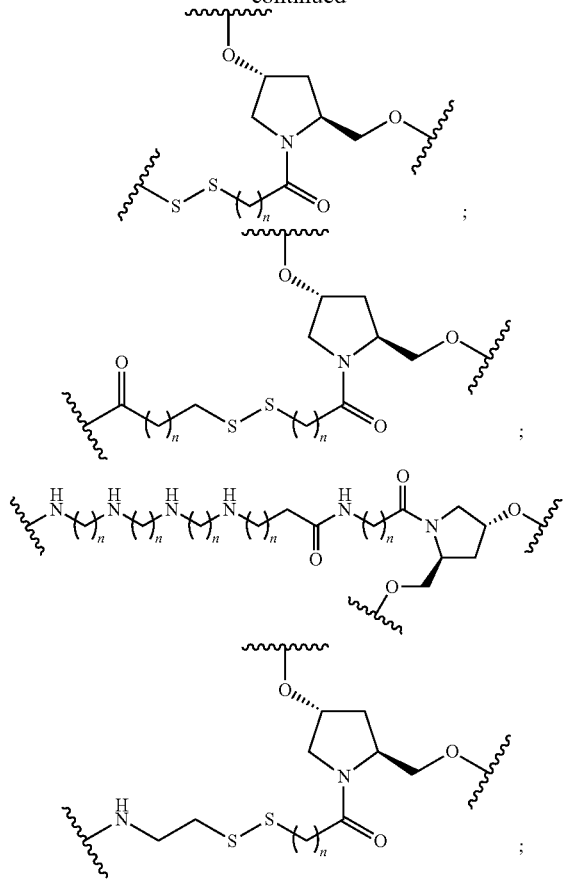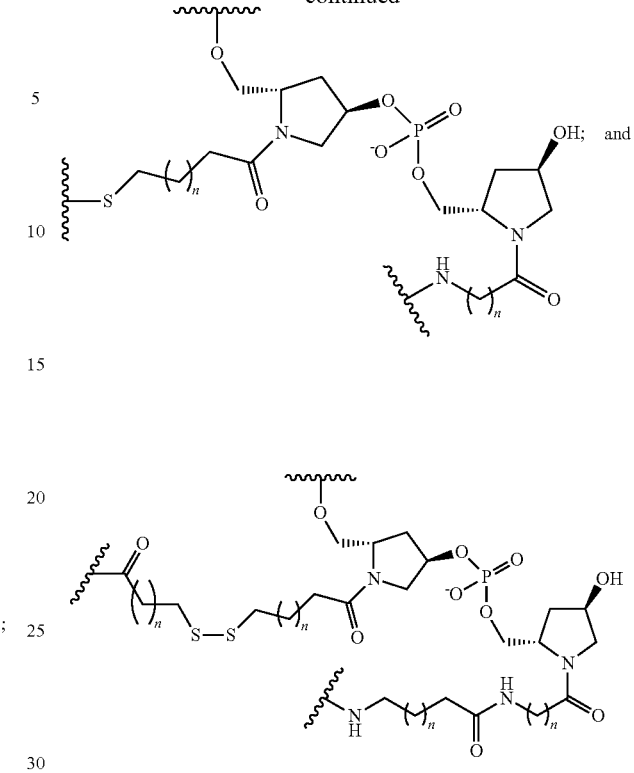
wherein each n is, independently, from 1 to 20; and p is from 1 to 6.
In certain embodiments, a linking group has a structure selected from among:
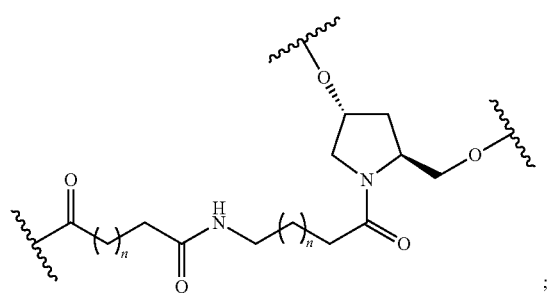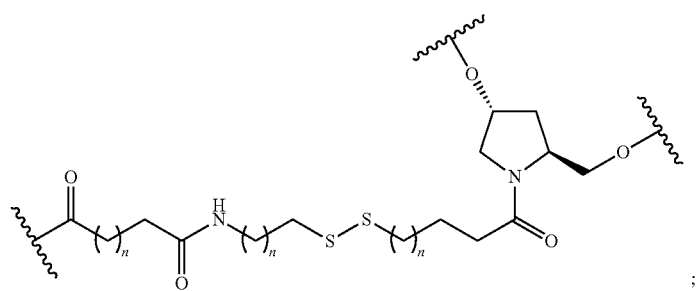

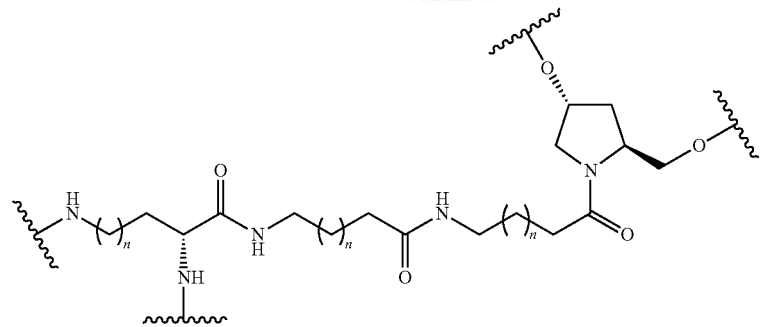
;
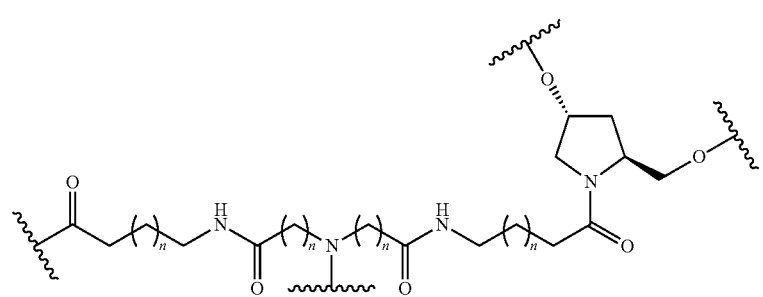
;
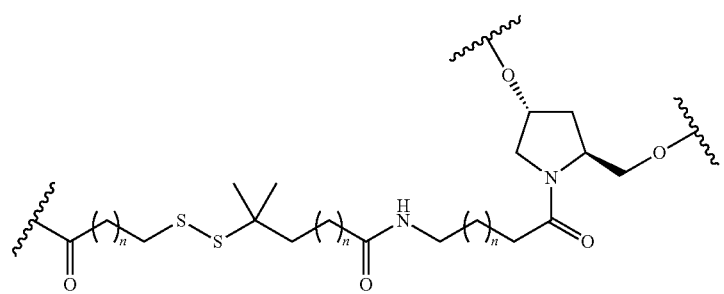
;
;
;

-continued
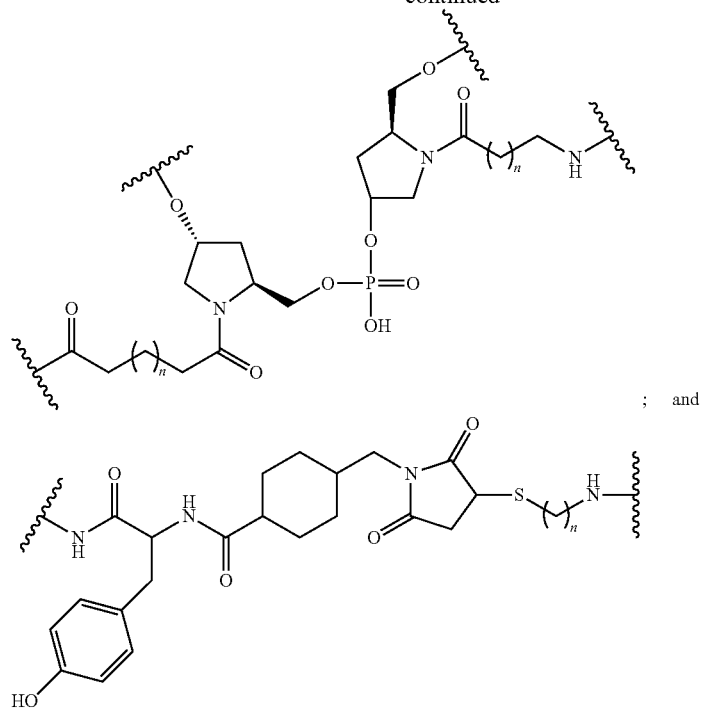
; and
wherein each n is, independently, from 1 to 20.
In certain embodiments, a linking group has a structure selected from among:
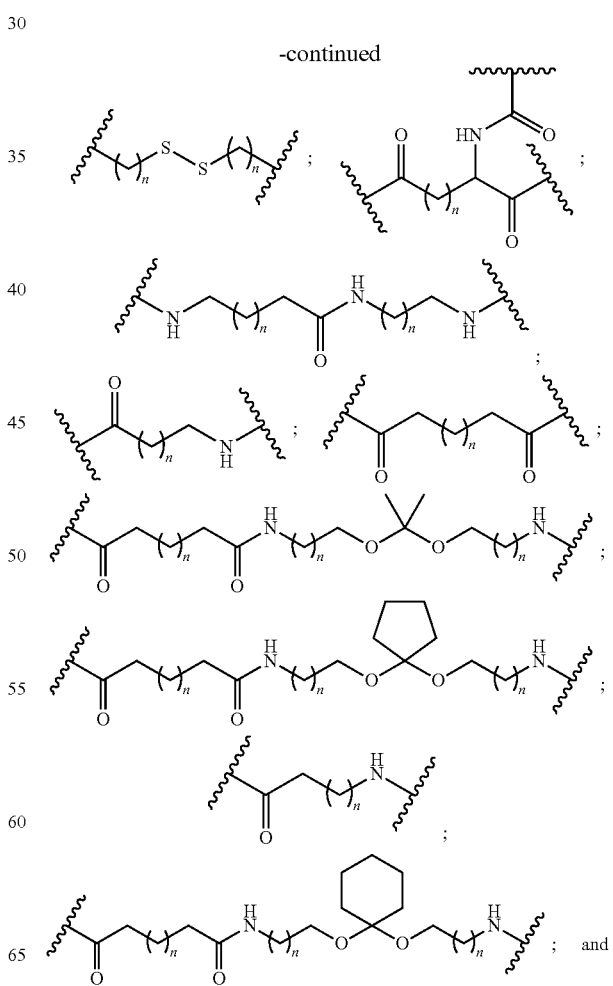

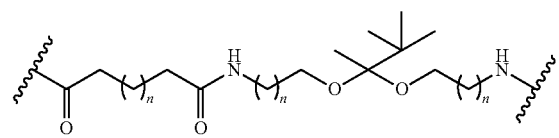
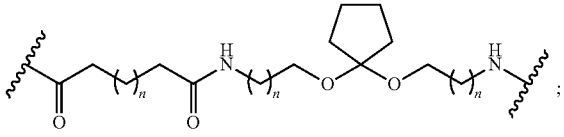
wherein n is from 1 to 20.
In certain embodiments, a linking group has a structure selected from among:
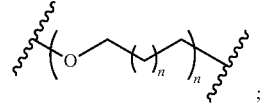
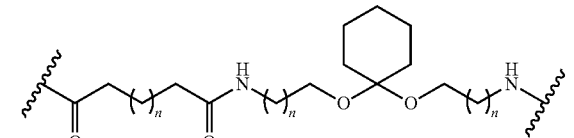
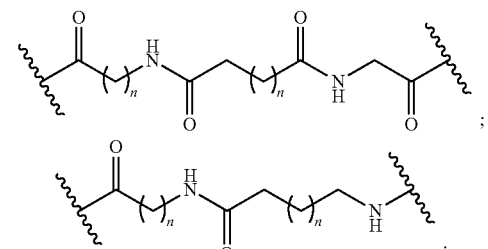
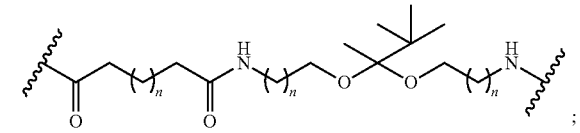
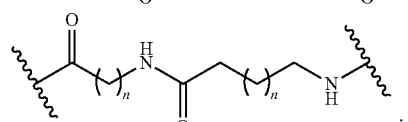
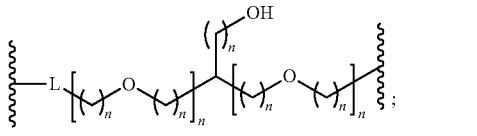
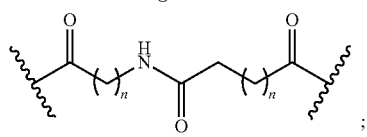
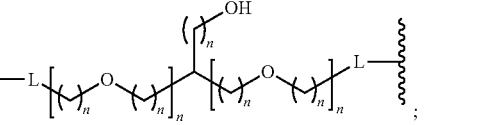
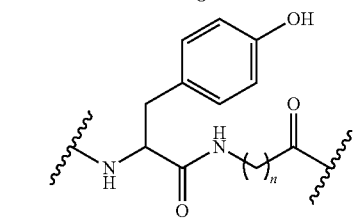
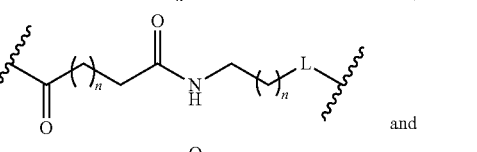
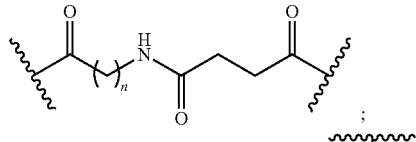
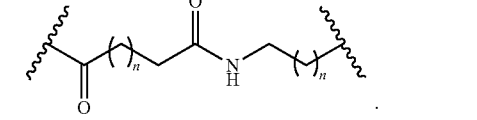
and
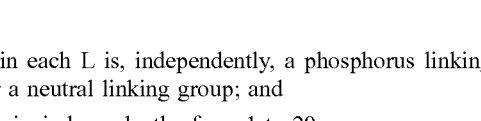
wherein each L is, independently, a phosphorus linking group or a neutral linking group; and
each n is, independently, from 1 to 20.
In certain embodiments, a linking group has a structure selected from among:
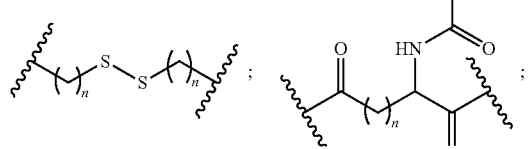
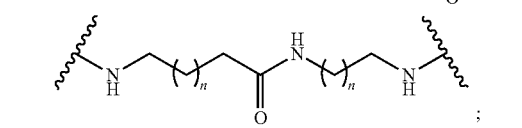
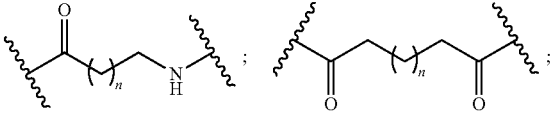
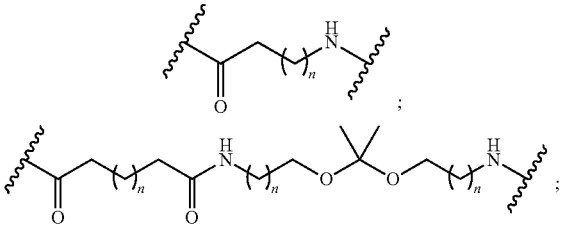
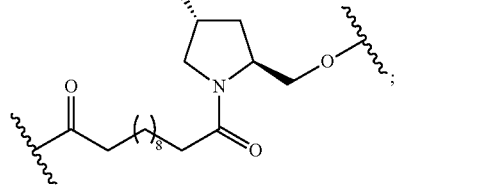

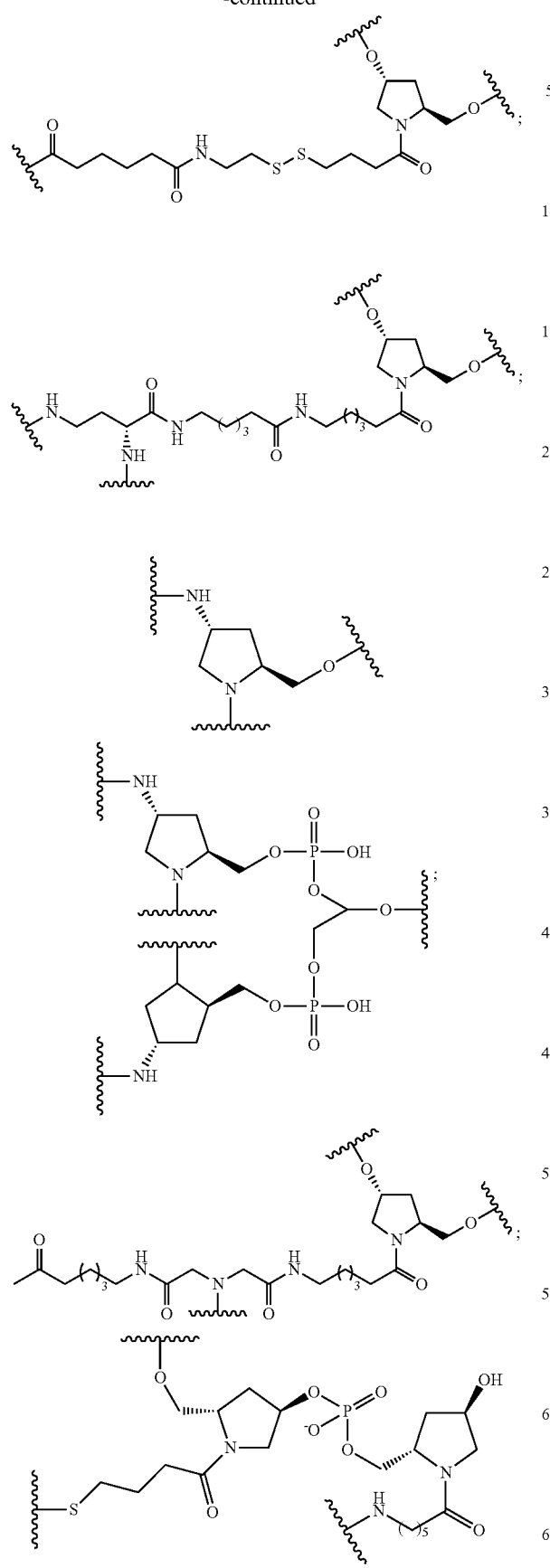
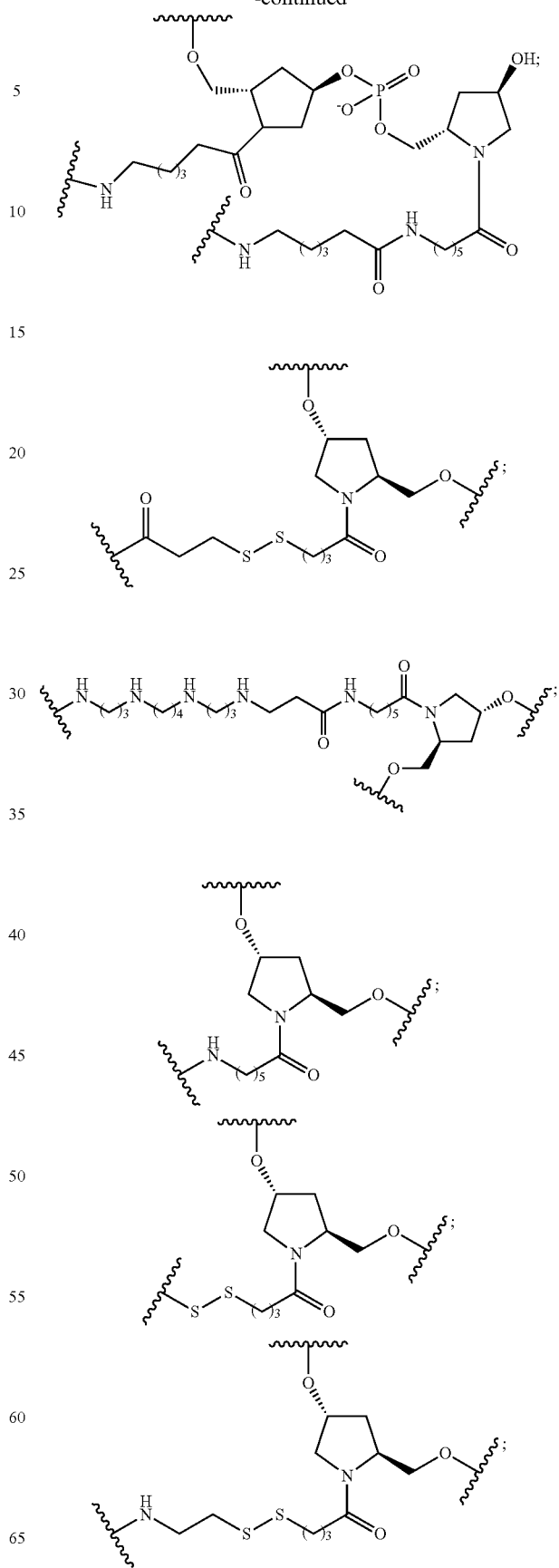

85
-continued
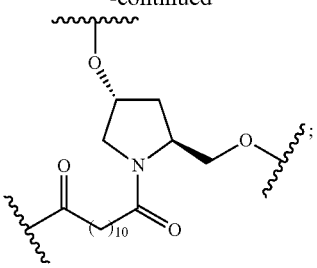
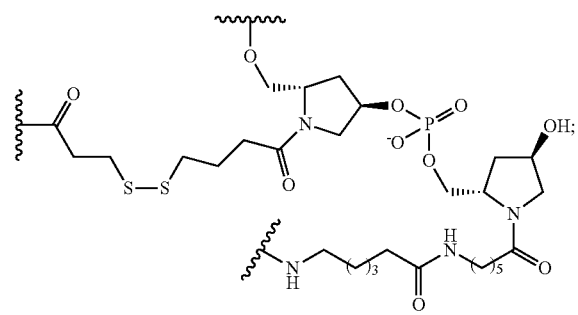
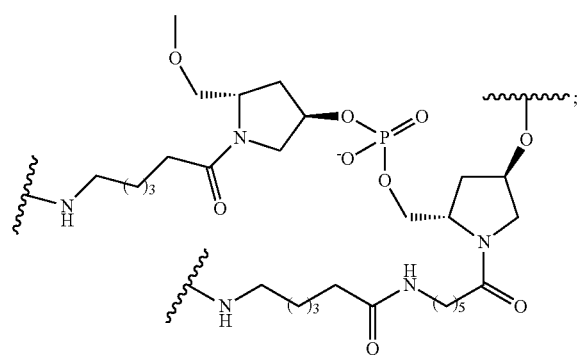
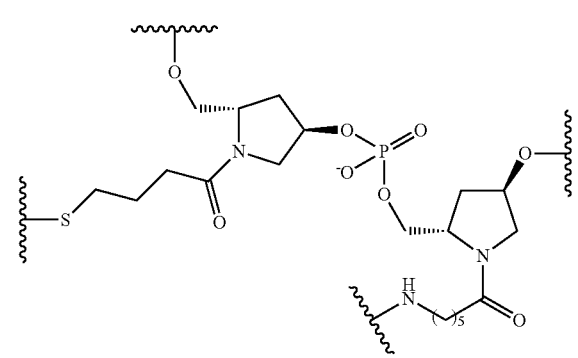
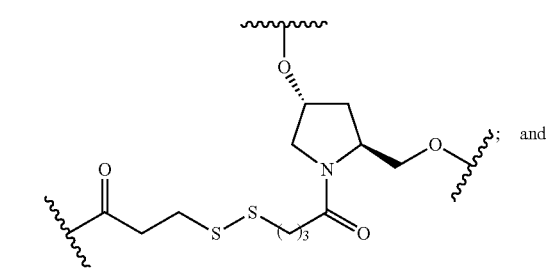
and
86
-continued
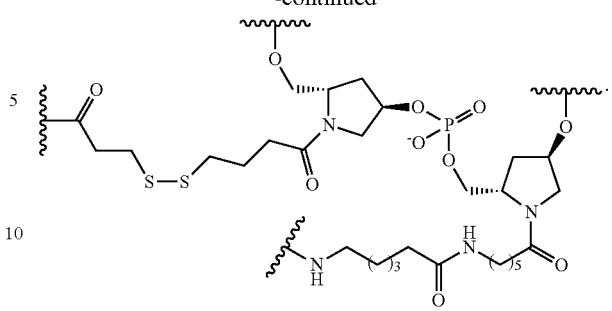
In certain embodiments, a linking group has a structure selected from among:
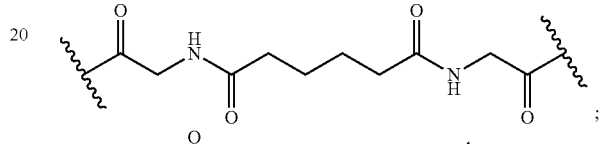
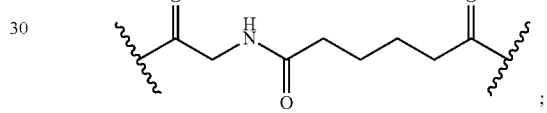
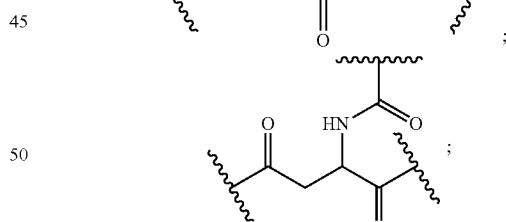
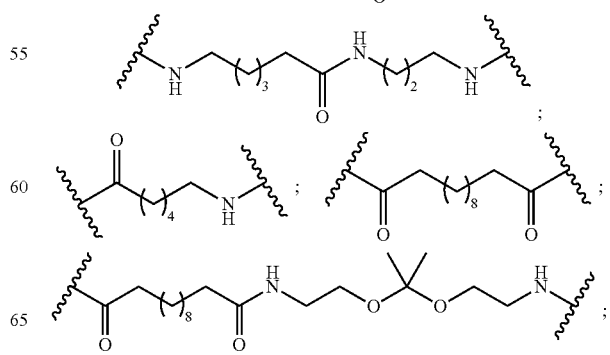

-continued
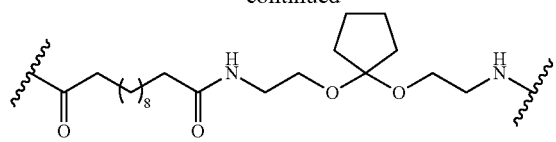
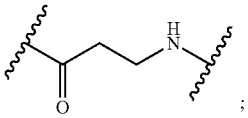
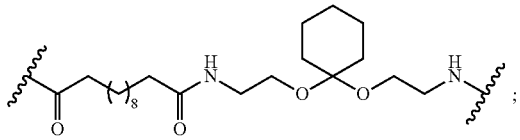; and
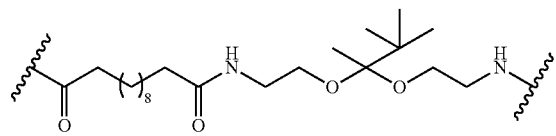
In certain embodiments, a linking group has a structure selected from among:
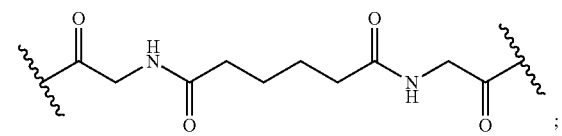
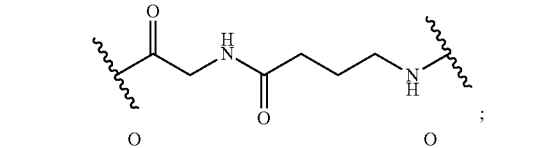
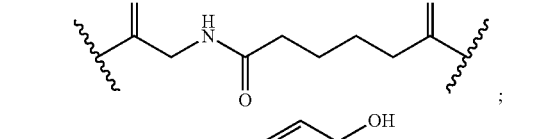
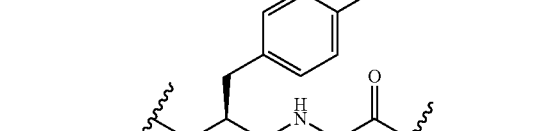
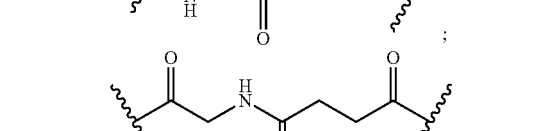
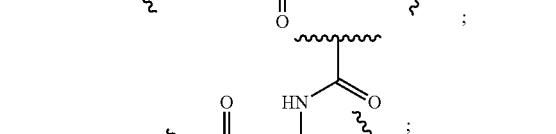
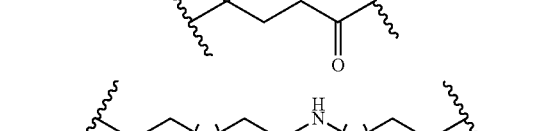
-continued
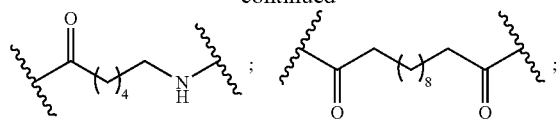
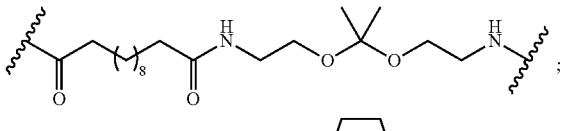
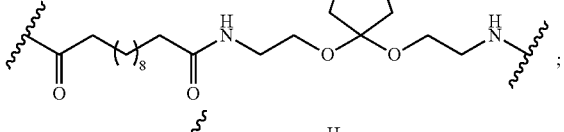
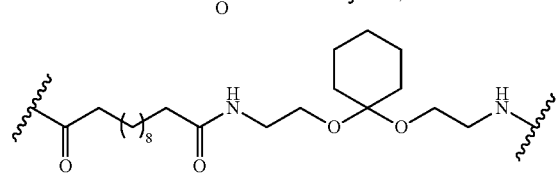
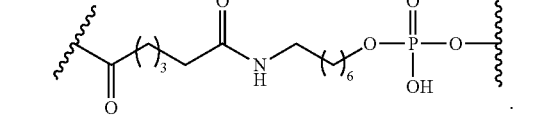
In certain embodiments, a linking group has a structure selected from among:

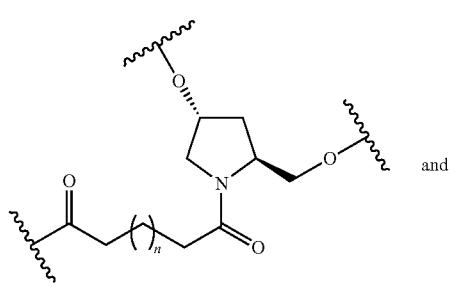

and

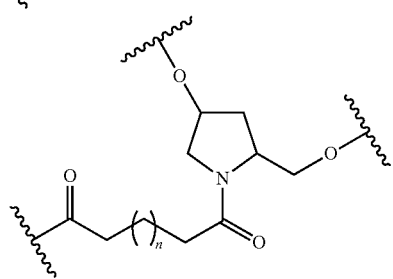

wherein n is from 1 to 20.

In certain embodiments, a linking group has a structure selected from among:

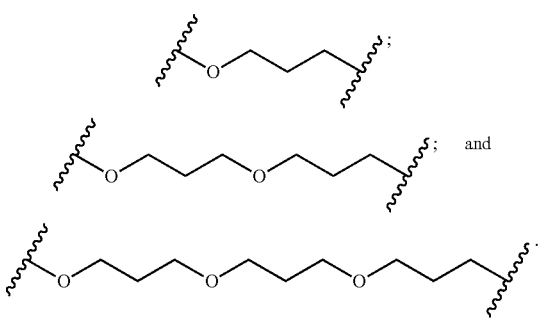

In certain embodiments, a linking group has a structure selected from among:

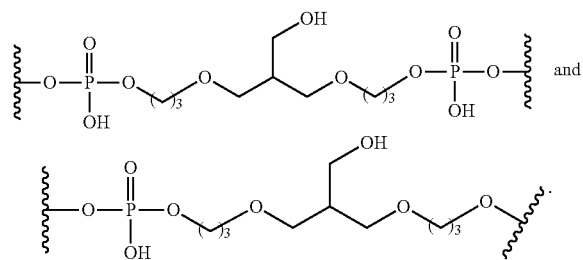

In certain embodiments, a linking group has a structure selected from among:

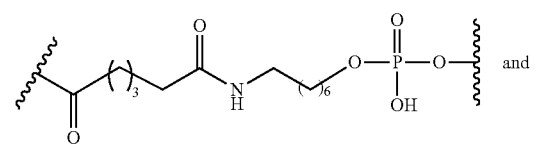

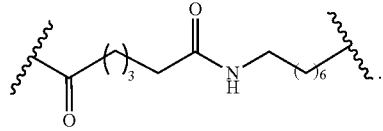

In certain embodiments, the conjugate linking group has the structure:

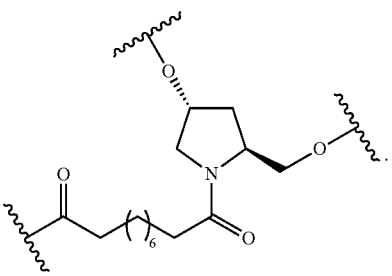

In certain embodiments, the conjugate linking group has the structure:

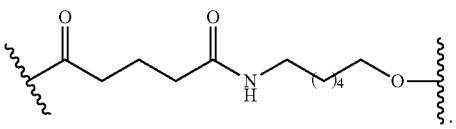

In certain embodiments, a linking group has a structure selected from among:

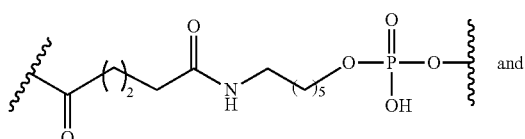

and

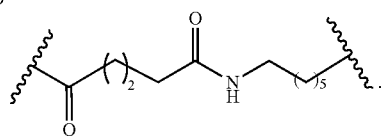

In certain embodiments, a linking group has a structure selected from among:

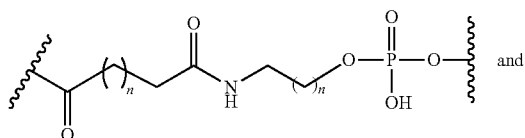

and

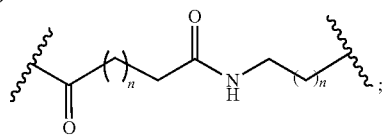

wherein each n is independently, 0, 1, 2, 3, 4, 5, 6, or 7.

1. Certain Branching Groups

In certain embodiments, the conjugate groups comprise a targeting moiety comprising a branching group and at least two tethered ligands. In certain embodiments, the branching group attaches the conjugate linker. In certain embodiments, the branching group attaches the cleavable moiety. In certain embodiments, the branching group attaches the antisense oligonucleotide. In certain embodiments, the branching group is covalently attached to the linker and each of the tethered ligands. In certain embodiments, the branching group comprises a branched aliphatic group comprising groups selected from alkyl, amide, disulfide, polyethylene glycol, ether, thioether and hydroxylamino groups. In certain embodiments, the branching group comprises groups selected from alkyl, amide and ether groups. In certain embodiments, the branching group comprises groups selected from alkyl and ether groups. In certain embodiments, the branching group comprises a mono or polycyclic ring system. In certain embodiments, the branching group comprises one or more cleavable bond. In certain embodiments, the conjugate group does not include a branching group.

In certain embodiments, a branching group has a structure selected from among:

-continued

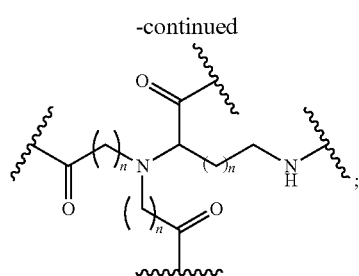

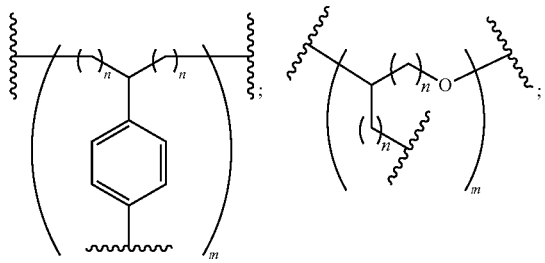

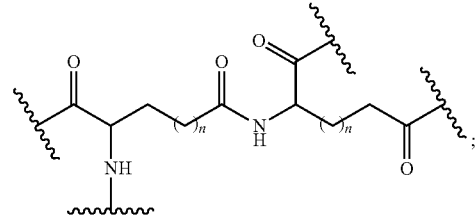

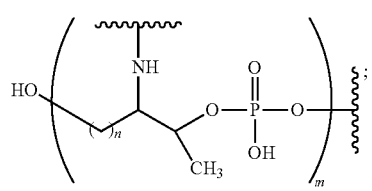

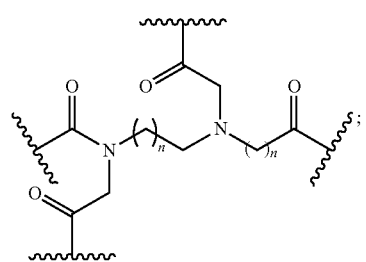

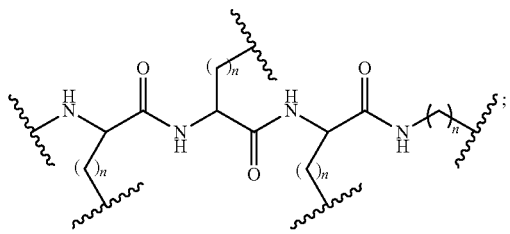

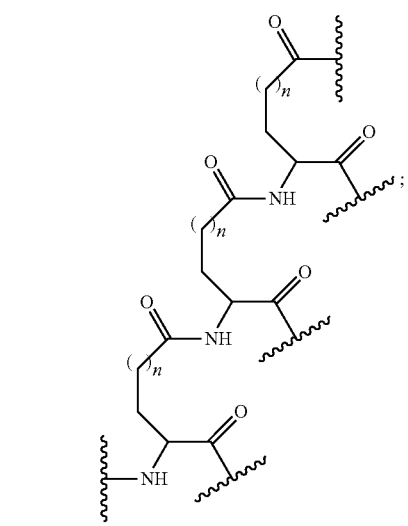

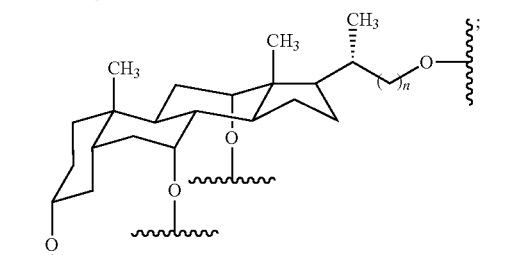

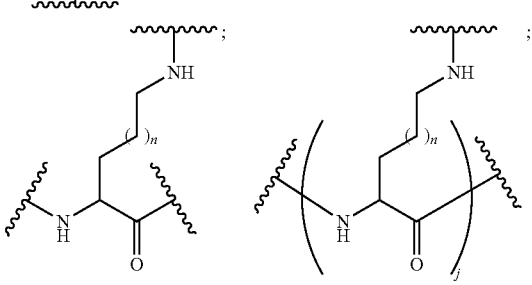

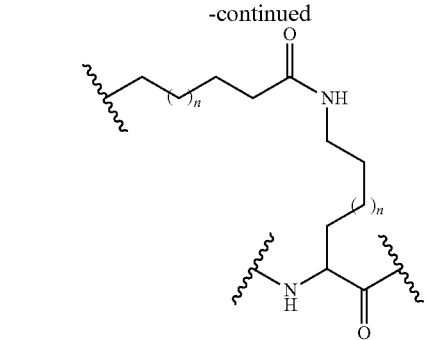
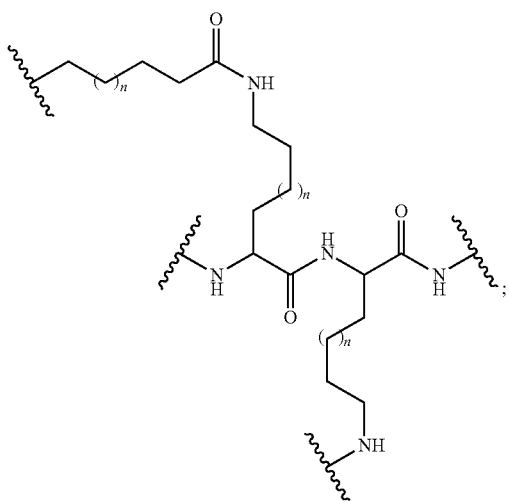
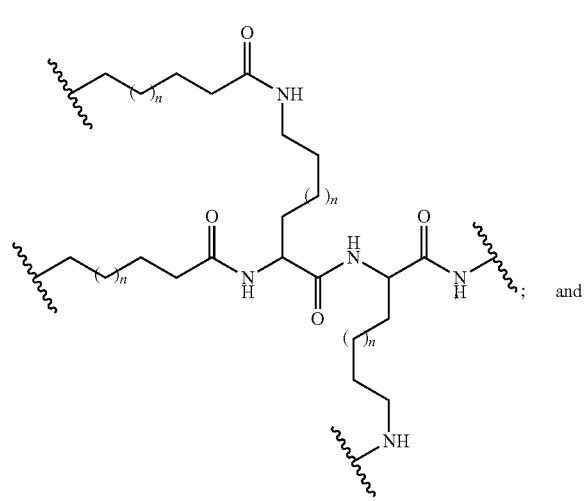
and
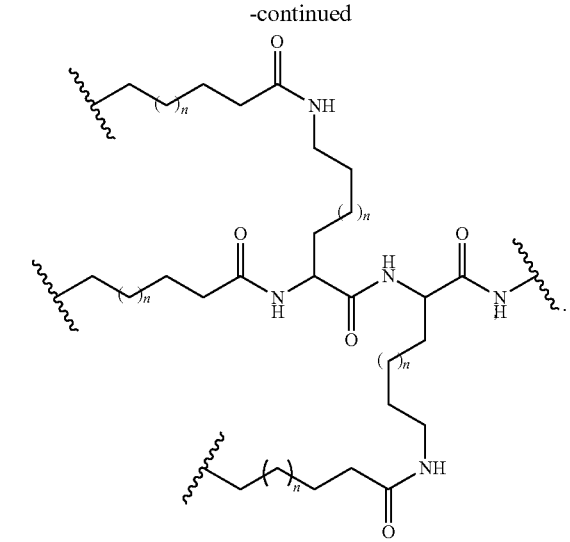
wherein each n is, independently, from 1 to 20;
j is from 1 to 3; and
m is from 2 to 6.
In certain embodiments, a branching group has a structure selected from among:
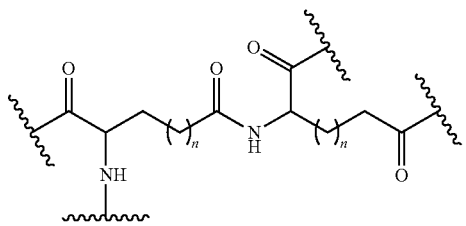
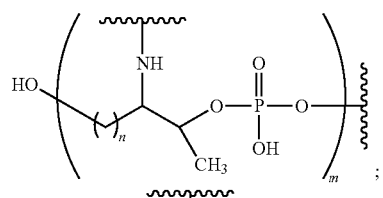
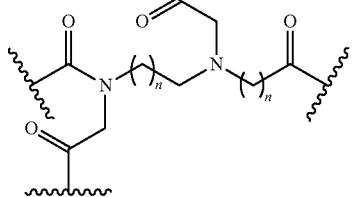
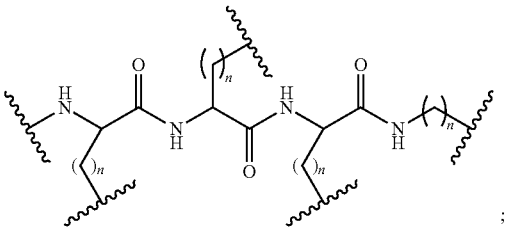

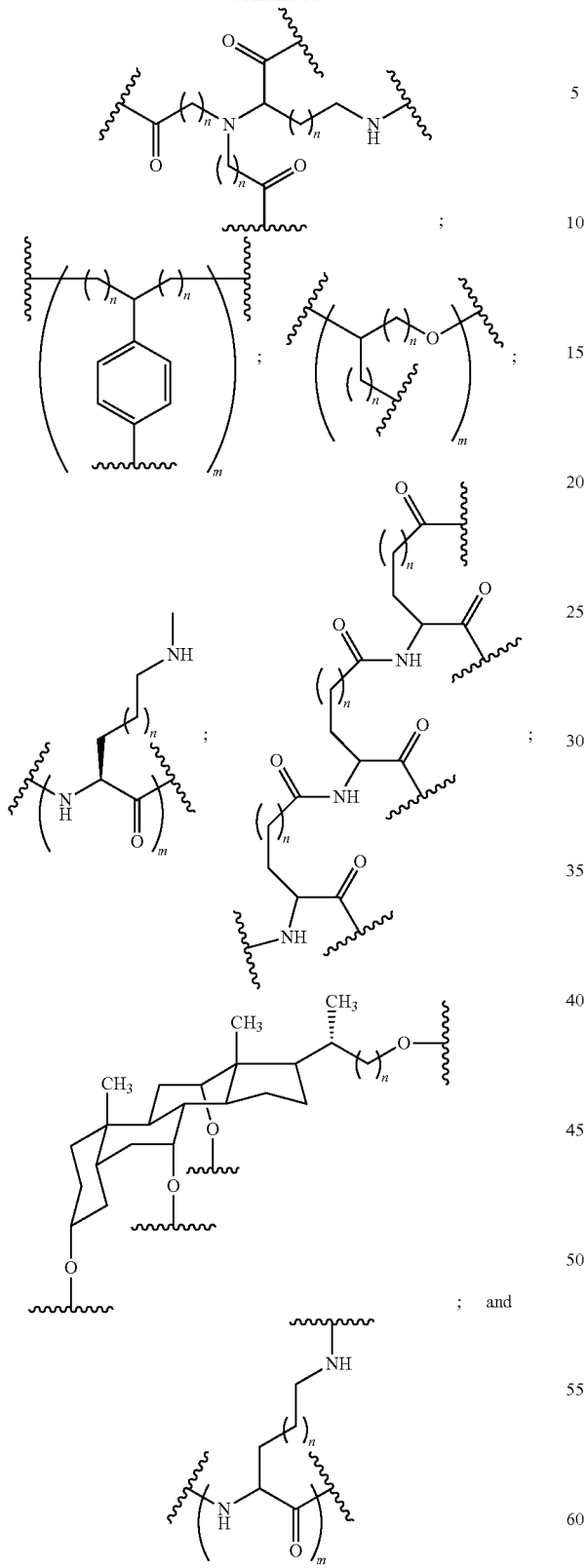
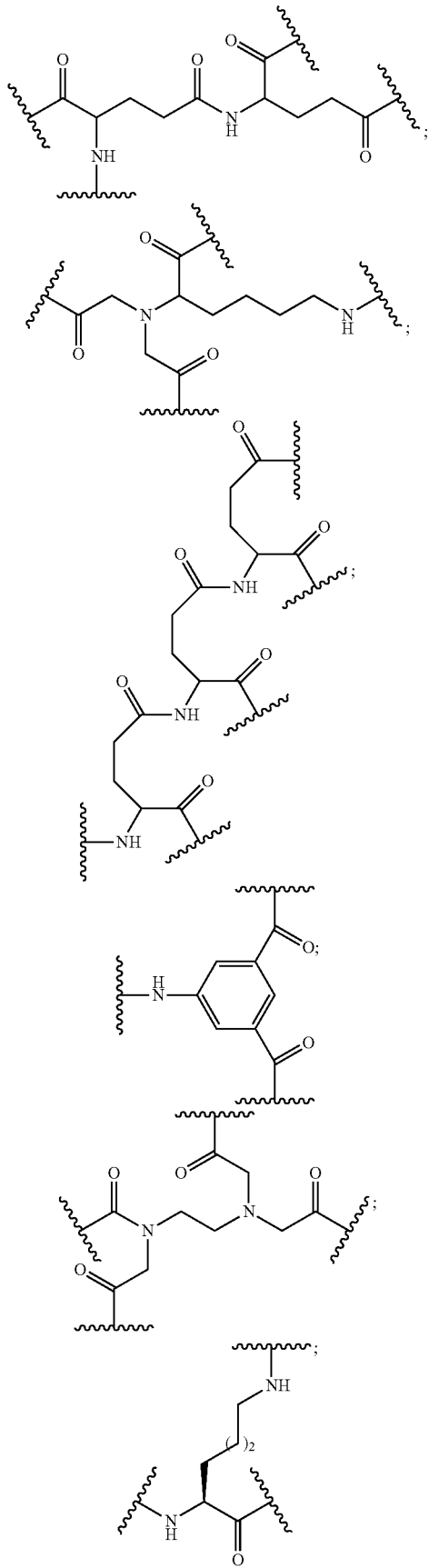
wherein each n is, independently, from 1 to 20; and m is from 2 to 6.
In certain embodiments, a branching group has a structure selected from among:

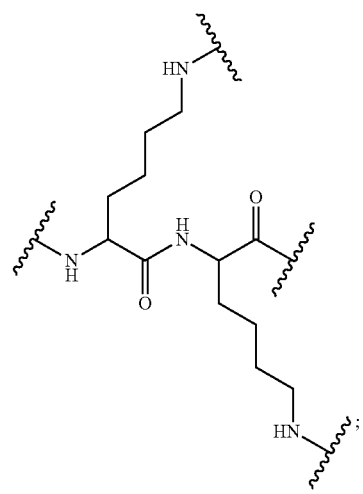
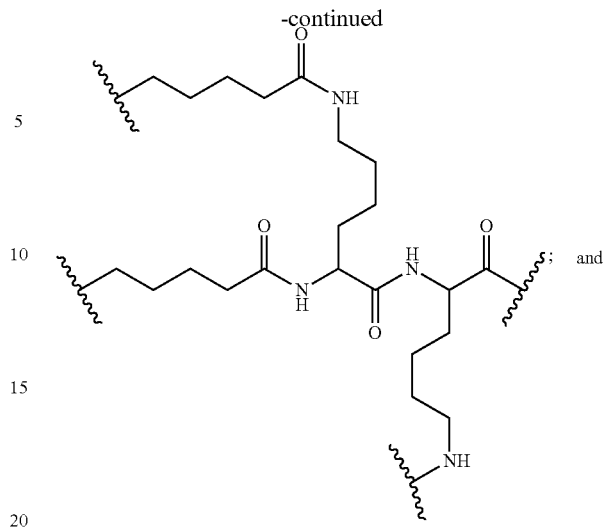
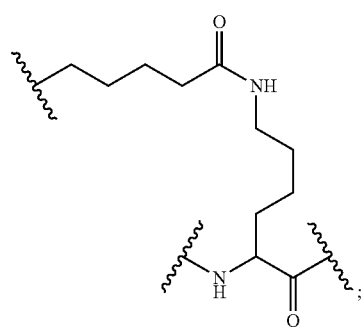
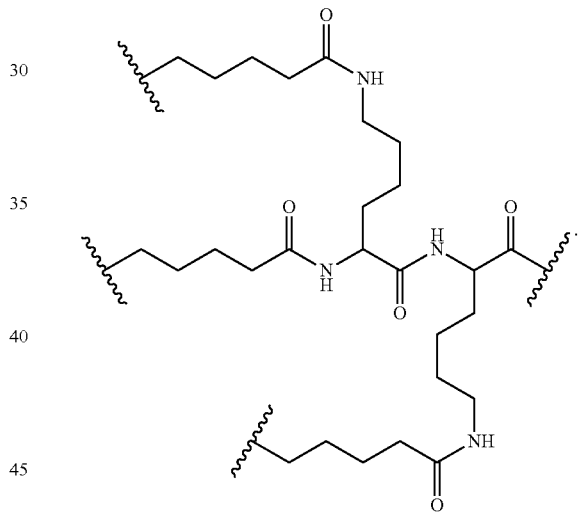
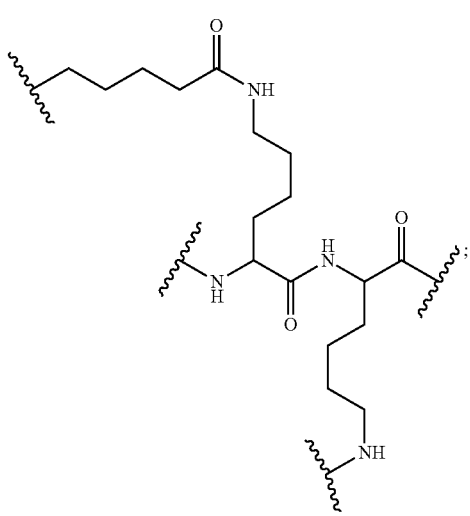
In certain embodiments, a branching group has a structure selected from among:
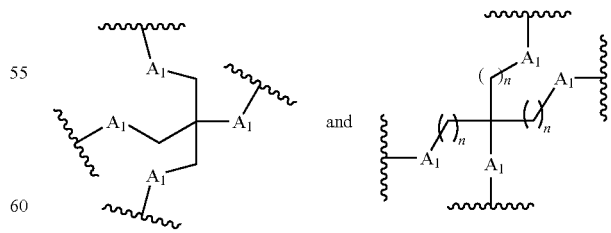
wherein each $A_1$ is independently, O, S, C=O or NH; and each n is, independently, from 1 to 20.
In certain embodiments, a branching group has a structure selected from among:

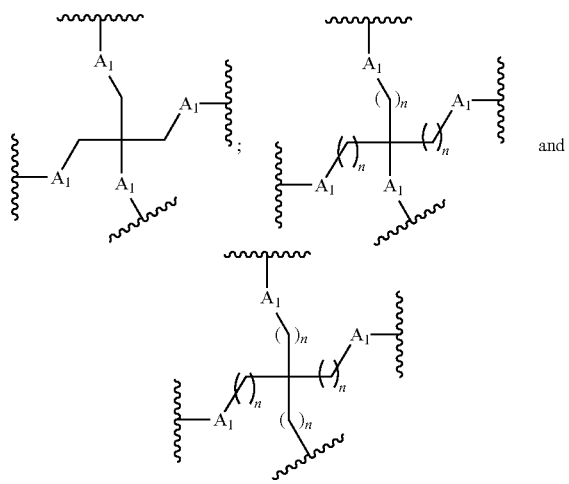

wherein each $A_1$ is independently, O, S, C=O or NH; and each n is, independently, from 1 to 20.

In certain embodiments, a branching group has a structure selected from among:

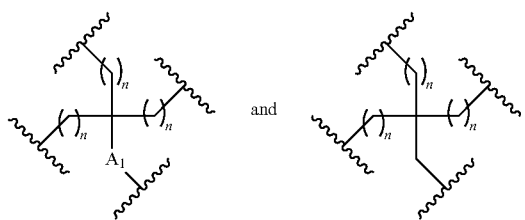

wherein $A_1$ is O, S, C=O or NH; and
each n is, independently, from 1 to 20.

In certain embodiments, a branching group has a structure selected from among:

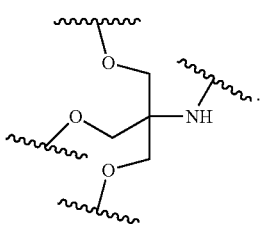 [SMILES: *NC(CO*)(CO*)CO*]

In certain embodiments, a branching group has a structure selected from among:

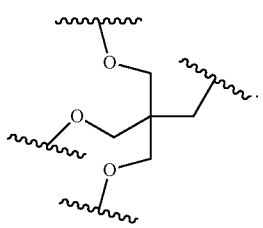 [SMILES: *CC(CO*)(CO*)CO*]

In certain embodiments, a branching group has a structure selected from among:

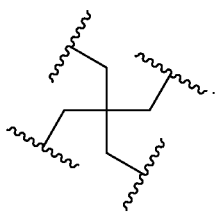 [SMILES: *CC(C*)(C*)C*]

iii. Certain Cleavable Moieties

In certain embodiments, a cleavable moiety is a cleavable bond. In certain embodiments, a cleavable moiety comprises a cleavable bond. In certain embodiments, the conjugate group comprises a cleavable moiety. In certain such embodiments, the cleavable moiety attaches to the antisense oligonucleotide. In certain such embodiments, the cleavable moiety attaches directly to the cell-targeting moiety. In certain such embodiments, the cleavable moiety attaches to the conjugate linker. In certain embodiments, the cleavable moiety comprises a phosphate or phosphodiester. In certain embodiments, the cleavable moiety is a cleavable nucleoside or nucleoside analog. In certain embodiments, the nucleoside or nucleoside analog comprises an optionally protected heterocyclic base selected from a purine, substituted purine, pyrimidine or substituted pyrimidine. In certain embodiments, the cleavable moiety is a nucleoside comprising an optionally protected heterocyclic base selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. In certain embodiments, the cleavable moiety is 2'-deoxy nucleoside that is attached to the 3' position of the antisense oligonucleotide by a phosphodiester linkage and is attached to the linker by a phosphodiester or phosphorothioate linkage. In certain embodiments, the cleavable moiety is 2'-deoxy adenosine that is attached to the 3' position of the antisense oligonucleotide by a phosphodiester linkage and is attached to the linker by a phosphodiester or phosphorothioate linkage. In certain embodiments, the cleavable moiety is 2'-deoxy adenosine that is attached to the 3' position of the antisense oligonucleotide by a phosphodiester linkage and is attached to the linker by a phosphodiester linkage.

In certain embodiments, the cleavable moiety is attached to the 3' position of the antisense oligonucleotide. In certain embodiments, the cleavable moiety is attached to the 5' position of the antisense oligonucleotide. In certain embodiments, the cleavable moiety is attached to a 2' position of the antisense oligonucleotide. In certain embodiments, the cleavable moiety is attached to the antisense oligonucleotide by a phosphodiester linkage. In certain embodiments, the cleavable moiety is attached to the linker by either a phosphodiester or a phosphorothioate linkage. In certain embodiments, the cleavable moiety is attached to the linker by a phosphodiester linkage. In certain embodiments, the conjugate group does not include a cleavable moiety.

In certain embodiments, the cleavable moiety is cleaved after the complex has been administered to an animal only after being internalized by a targeted cell. Inside the cell the cleavable moiety is cleaved thereby releasing the active antisense oligonucleotide. While not wanting to be bound by theory it is believed that the cleavable moiety is cleaved by one or more nucleases within the cell. In certain embodiments, the one or more nucleases cleave the phosphodiester linkage between the cleavable moiety and the linker. In certain embodiments, the cleavable moiety has a structure selected from among the following:

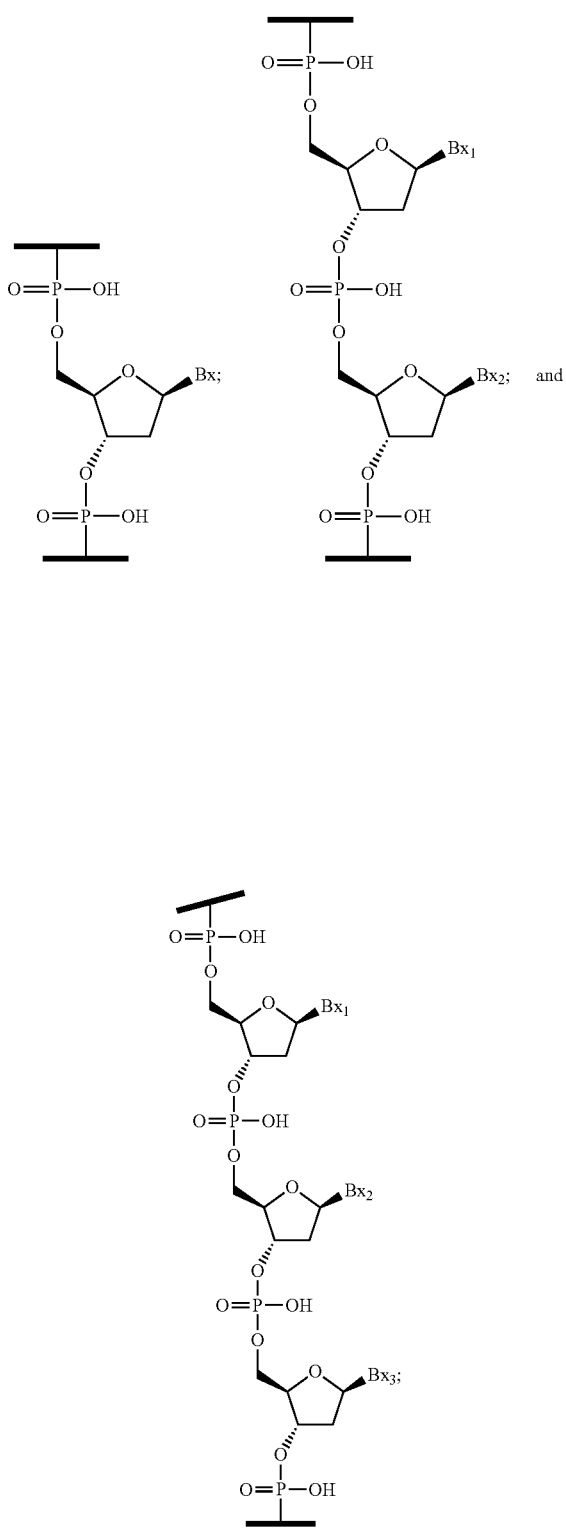

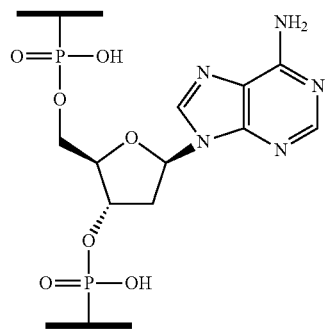

iv. Certain Cell-Targeting Moieties

In certain embodiments, conjugate groups comprise cell-targeting moieties. Certain such cell-targeting moieties increase cellular uptake of antisense compounds. In certain embodiments, cell-targeting moieties comprise a branching group, one or more tether, and one or more ligand. In certain embodiments, cell-targeting moieties comprise a branching group, one or more tether, one or more ligand and one or more cleavable bond.

2. Certain Ligands

In certain embodiments, the present disclosure provides ligands wherein each ligand is covalently attached to a tether. In certain embodiments, each ligand is selected to have an affinity for at least one type of receptor on a target cell. In certain embodiments, ligands are selected that have an affinity for at least one type of receptor on the surface of a mammalian liver cell. In certain embodiments, ligands are selected that have an affinity for the hepatic asialoglycoprotein receptor (ASGP-R). In certain embodiments, each ligand is a carbohydrate. In certain embodiments, each ligand is, independently selected from galactose, N-acetyl galactoseamine, mannose, glucose, glucosamone and fucose. In certain embodiments, each ligand is N-acetyl galactoseamine (GalNAc). In certain embodiments, the targeting moiety comprises 2 to 6 ligands. In certain embodiments, the targeting moiety comprises 3 ligands. In certain embodiments, the targeting moiety comprises 3 N-acetyl galactoseamine ligands.

In certain embodiments, the ligand is a carbohydrate, carbohydrate derivative, modified carbohydrate, multivalent carbohydrate cluster, polysaccharide, modified polysaccharide, or polysaccharide derivative. In certain embodiments, the ligand is an amino sugar or a thio sugar. For example, amino sugars may be selected from any number of compounds known in the art, for example glucosamine, sialic acid, α-D-galactosamine, N-Acetylgalactosamine, 2-acetamido-2-deoxy-D-galactopyranose (GalNAc), 2-Amino-3- wherein each of Bx, Bx₁, Bx₂, and Bx₃ is independently a heterocyclic base moiety. In certain embodiments, the cleavable moiety has a structure selected from among the following:

O—[(R)-1-carboxyethyl]-2-deoxy-β-D-glucopyranose (β-muramic acid), 2-Deoxy-2-methylamino-L-glucopyranose, 4,6-Dideoxy-4-formamido-2,3-di-O-methyl-D-mannopyranose, 2-Deoxy-2-sulfoamino-D-glucopyranose and N-sulfo-D-glucosamine, and N-Glycoloyl-α-neuraminic acid. For example, thio sugars may be selected from the group consisting of 5-Thio-β-D-glucopyranose, Methyl 2,3,4-tri-O-acetyl-1-thio-6-0-trityl-α-D-glucopyranoside, 4-Thio-β-D-galactopyranose, and ethyl 3,4,6,7-tetra-O-acetyl-2-deoxy-1,5-dithio-α-D-gluco-heptopyranoside.

In certain embodiments, "GalNac" or "Gal-NAc" refers to 2-(Acetylamino)-2-deoxy-D-galactopyranose, commonly referred to in the literature as N-acetyl galactosamine. In certain embodiments, "N-acetyl galactosamine" refers to 2-(Acetylamino)-2-deoxy-D-galactopyranose. In certain embodiments, "GalNac" or "Gal-NAc" refers to 2-(Acetylamino)-2-deoxy-D-galactopyranose. In certain embodiments, "GalNac" or "Gal-NAc" refers to 2-(Acetylamino)-2-deoxy-D-galactopyranose, which includes both the β-form: 2-(Acetylamino)-2-deoxy-β-D-galactopyranose and α-form: 2-(Acetylamino)-2-deoxy-D-galactopyranose. In certain embodiments, both the β-form: 2-(Acetylamino)-2-deoxy-β-D-galactopyranose and α-form: 2-(Acetylamino)-2-deoxy-D-galactopyranose may be used interchangeably. Accordingly, in structures in which one form is depicted, these structures are intended to include the other form as well. For example, where the structure for an α-form: 2-(Acetylamino)-2-deoxy-D-galactopyranose is shown, this structure is intended to include the other form as well. In certain embodiments, In certain preferred embodiments, the β-form 2-(Acetylamino)-2-deoxy-D-galactopyranose is the preferred embodiment.

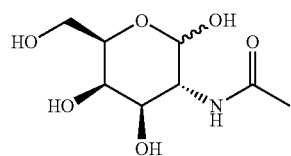

2-(Acetylamino)-2-deoxy-D-galactopyranose

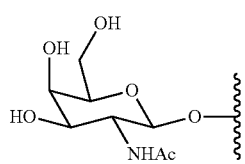

2-(Acetylamino)-2-deoxy-β-D-galactopyranose.

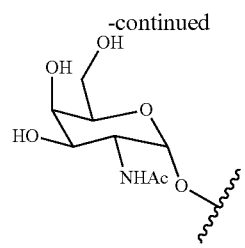

2-(Acetylamino)-2-deoxy-α-D-galactopyranose.

In certain embodiments a compound comprises an oligomer and a conjugate group, wherein the conjugate group comprises a moiety having Formula I:

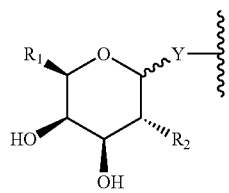

I wherein:

$R_1$ is selected from $Q_1$, $CH_2Q_1$, $CH_2OH$, $CH_2NJ_1J_2$, $CH_2N_3$ and $CH_2SJ_3$;

$Q_1$ is selected from aryl, substituted aryl, heterocyclic, substituted heterocyclic, heteroaryl and substituted heteroaryl;

$R_2$ is selected from $N_3$, CN, halogen, $N(H)C(=O)-Q_2$, substituted thiol, aryl, substituted aryl, heterocyclic, substituted heterocyclic, heteroaryl and substituted heteroaryl;

$Q_2$ is selected from H, $C_1$-$C_6$ alkyl, substituted $C_1$-$C_6$ alkyl, $C_1$-$C_6$ alkoxy, substituted $C_1$-$C_6$ alkoxy, aryl, substituted aryl, heterocyclic, substituted heterocyclic, heteroaryl and substituted heteroaryl;

Y is selected from O, S, $CJ_4J_5$, $NJ_6$ and $N(J_6)C(=O)$;

$J_1$, $J_2$, $J_3$, $J_4$, $J_5$, and $J_6$ are each, independently, H or a substituent group;

each substituent group is, independently, mono or poly substituted with optionally protected substituent groups independently selected from halogen, $C_1$-$C_6$ alkyl, $C_1$-$C_6$ alkoxy, aryl, heterocyclic and heteroaryl wherein each substituent group can include a connecting group comprising a linear alkyl group optionally including one or more groups independently selected from O, S, NH and C(=O), and wherein each substituent group may be further substituted with one or more groups independently selected from $C_1$-$C_6$ alkyl, halogen or $C_1$-$C_6$ alkoxy wherein each cyclic group is mono or polycyclic; and when Y is O and $R_1$ is OH then $R_2$ is other than OH and $N(H)C(=O)CH_3$.

i. Certain Conjugates

In certain embodiments, conjugate groups comprise the structural features above. In certain such embodiments, conjugate groups have the following structure:

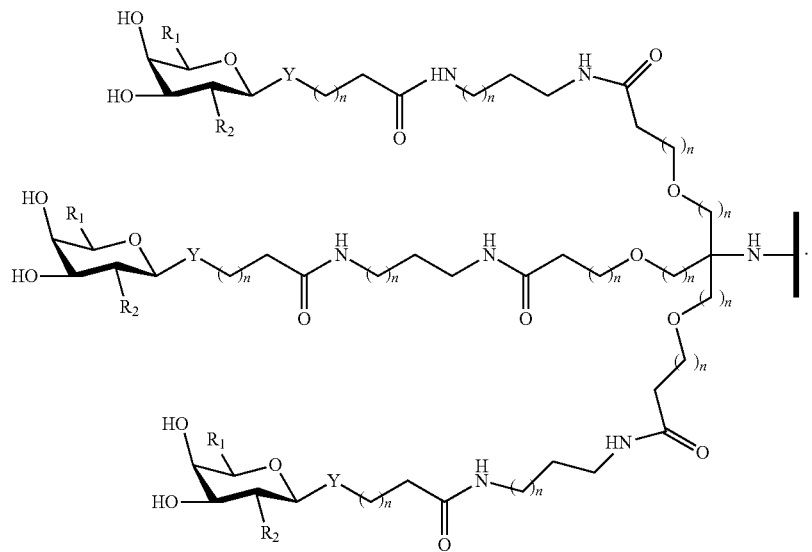
wherein each n is, independently, from 1 to 20.
In certain such embodiments, conjugate groups have the following structure:
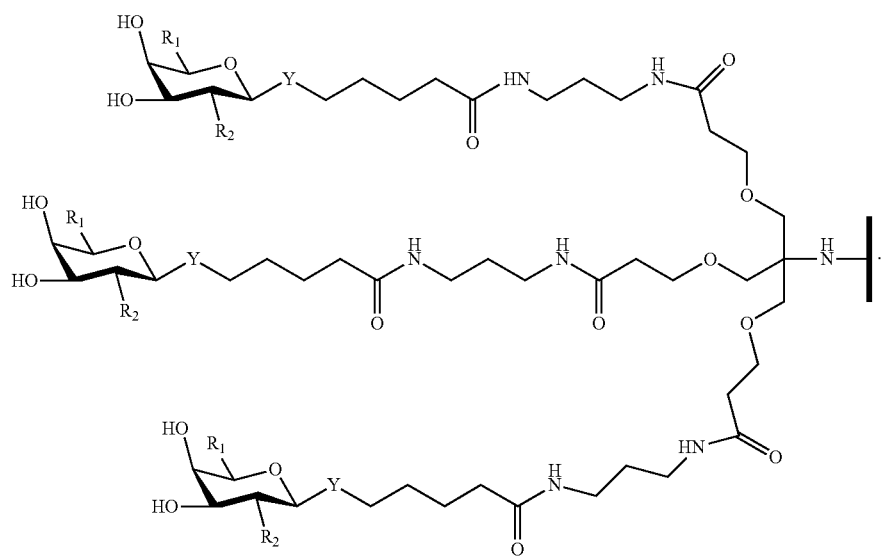
In certain such embodiments, conjugate groups have the following structure:

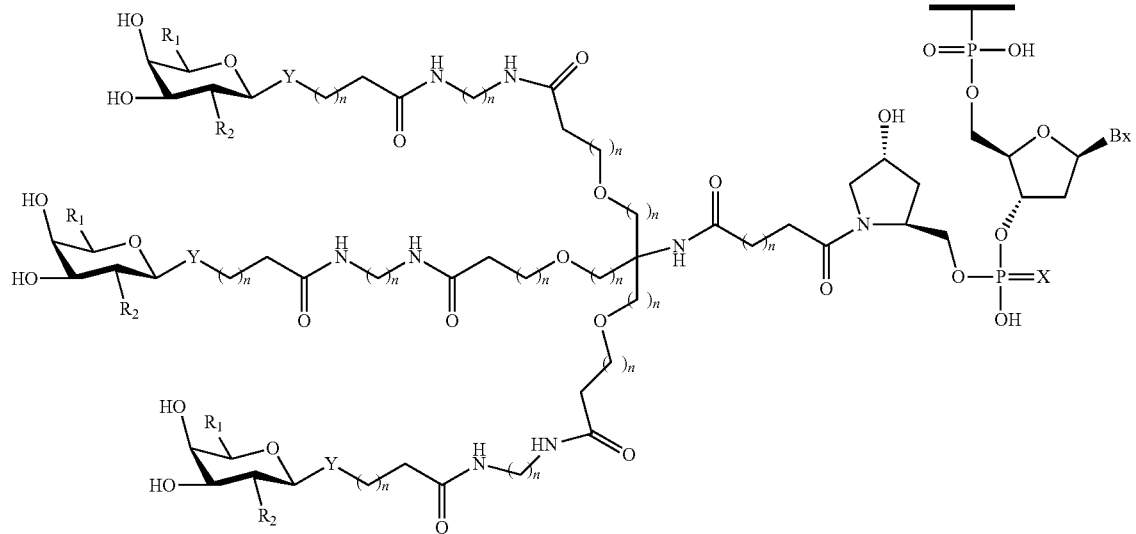
wherein each n is, independently, from 1 to 20;
Z is H or a linked solid support;
Q is an antisense compound;
X is O or S; and
Bx is a heterocyclic base moiety.
In certain such embodiments, conjugate groups have the following structure:
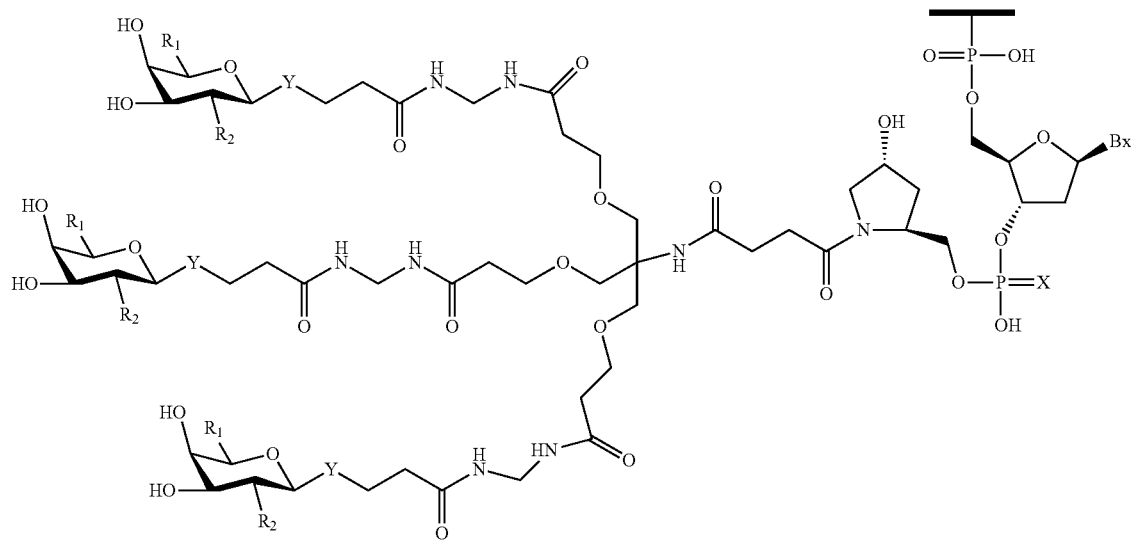
In certain such embodiments, conjugate groups have the following structure:

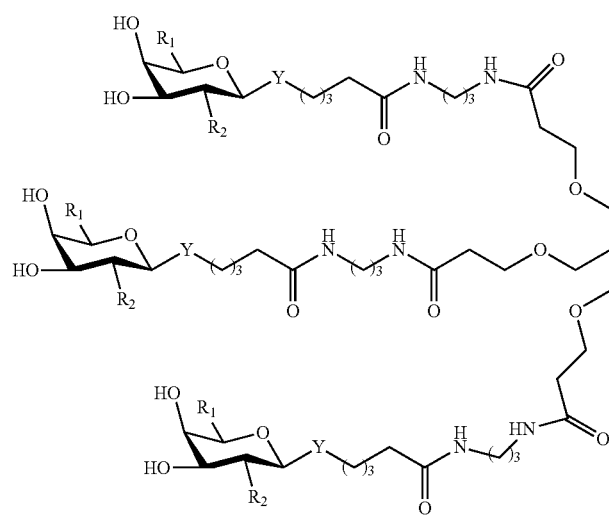
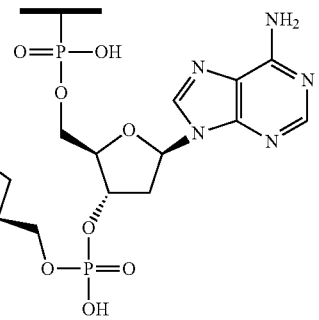
In certain such embodiments, conjugate groups have the following structure:
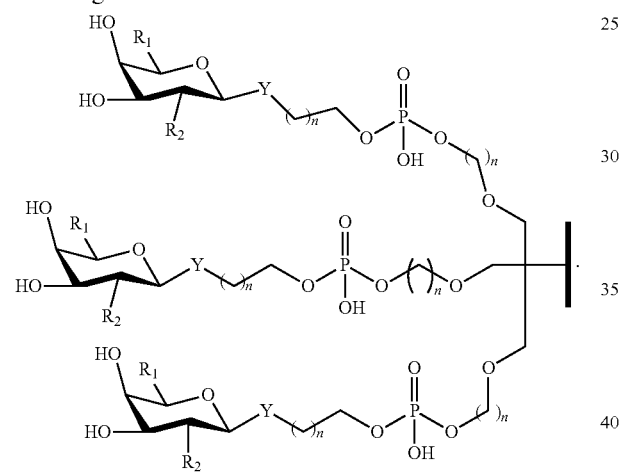
In certain such embodiments, conjugate groups have the following structure:
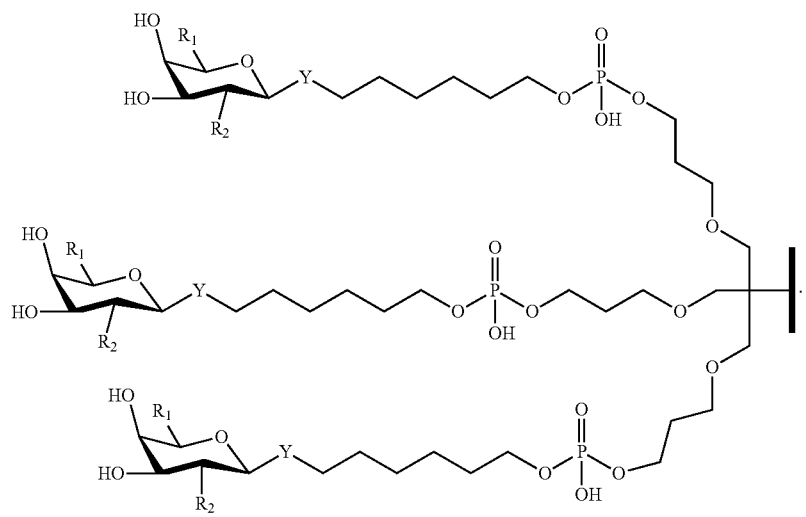

In certain such embodiments, conjugate groups have the following structure:
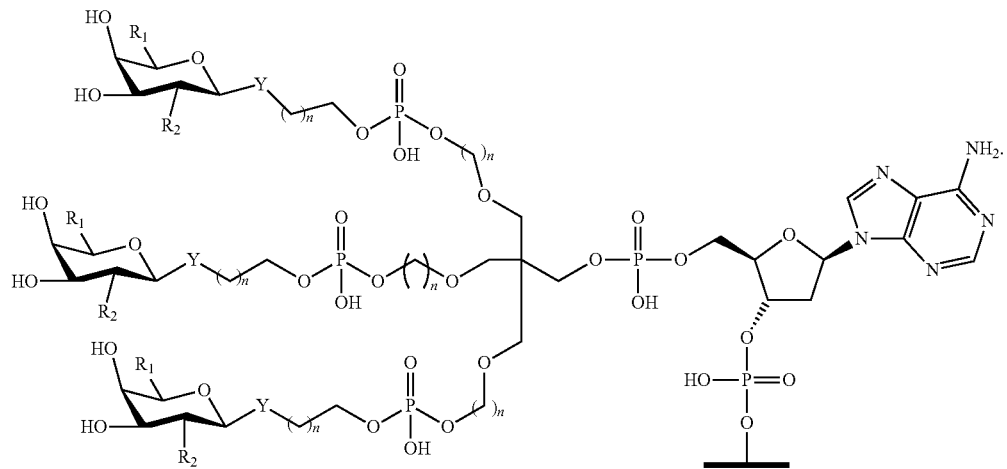
In certain such embodiments, conjugate groups have the following structure:
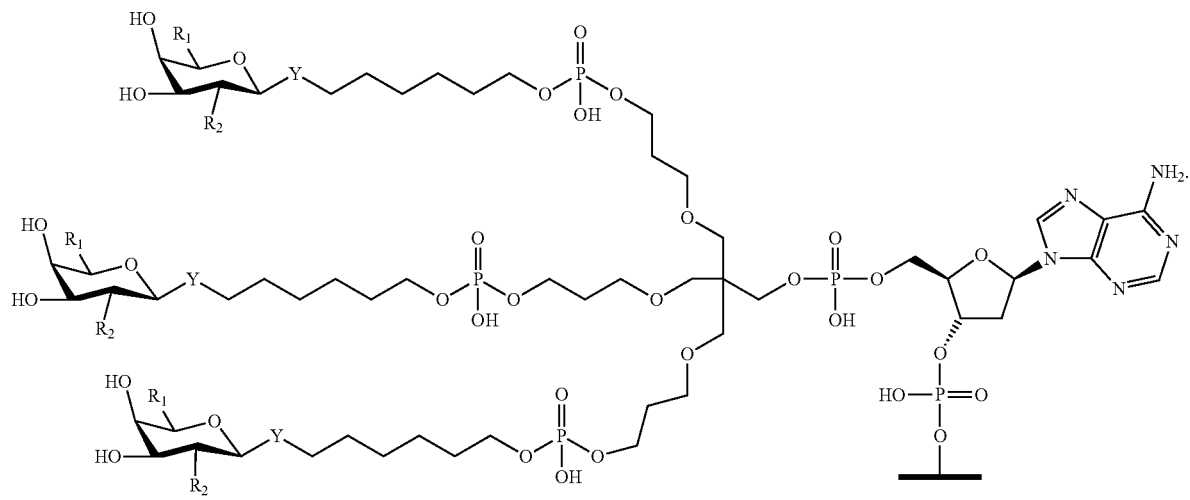
In certain such embodiments, conjugate groups have the following structure:

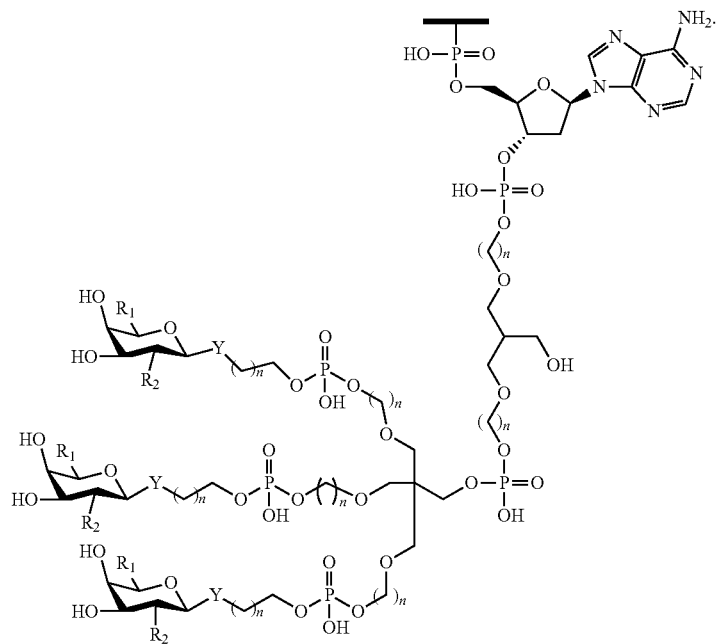
In certain such embodiments, conjugate groups have the following structure:
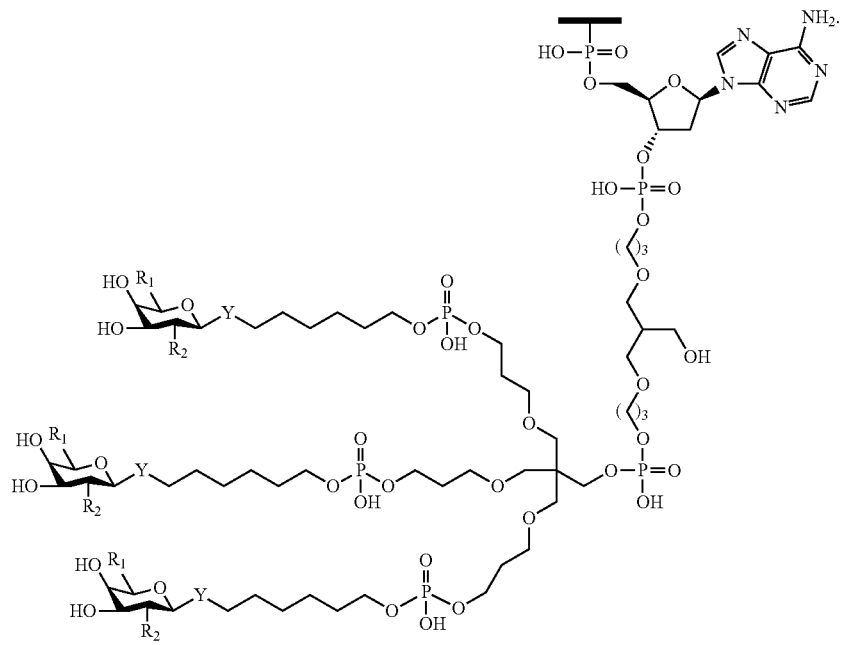
In certain embodiments, conjugates do not comprise a pyrrolidine.
In certain such embodiments, conjugate groups have the following structure:

115
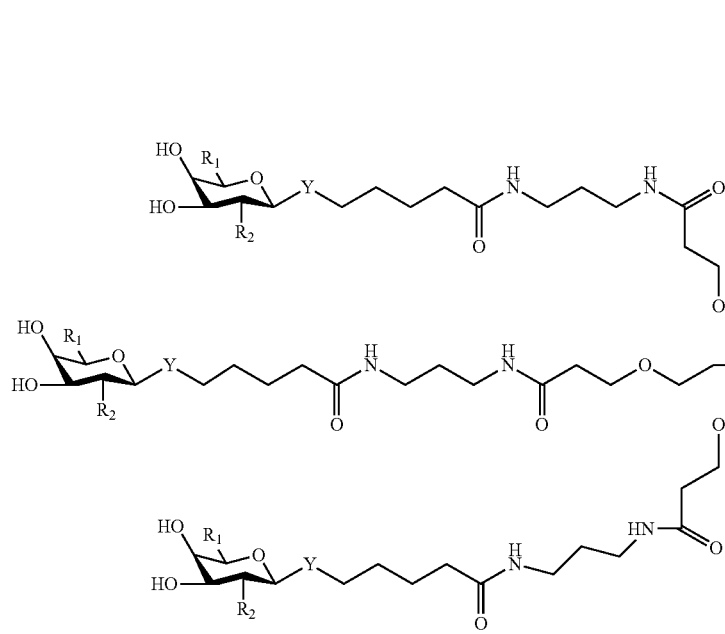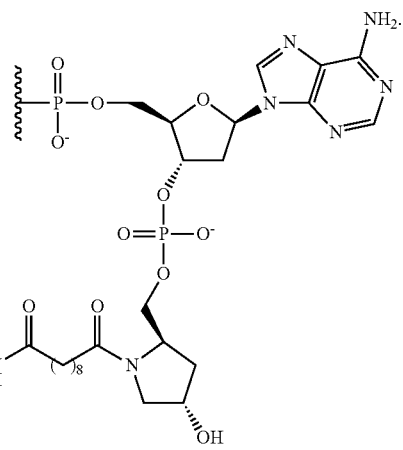
In certain such embodiments, conjugate groups have the following structure:
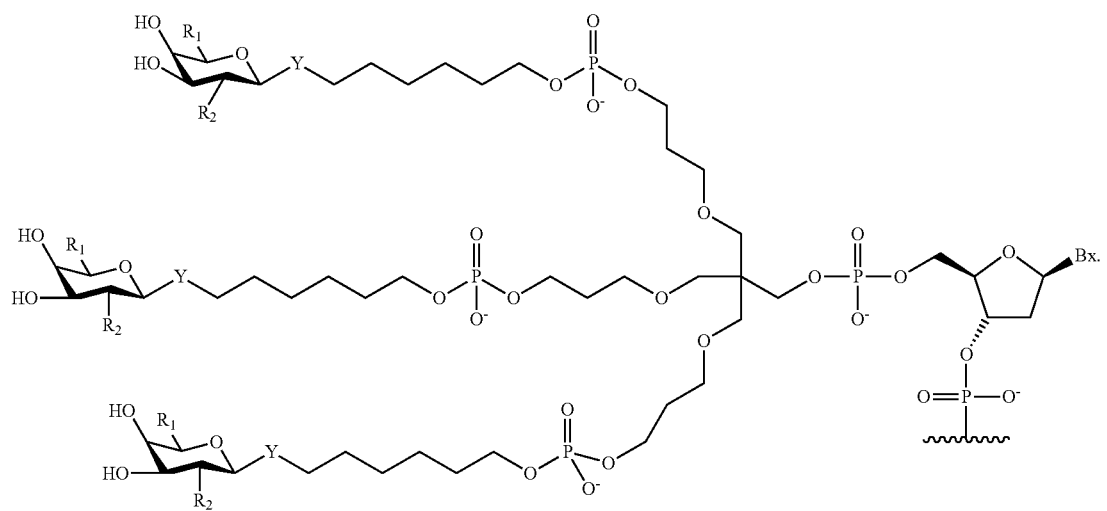
In certain such embodiments, conjugate groups have the following structure:

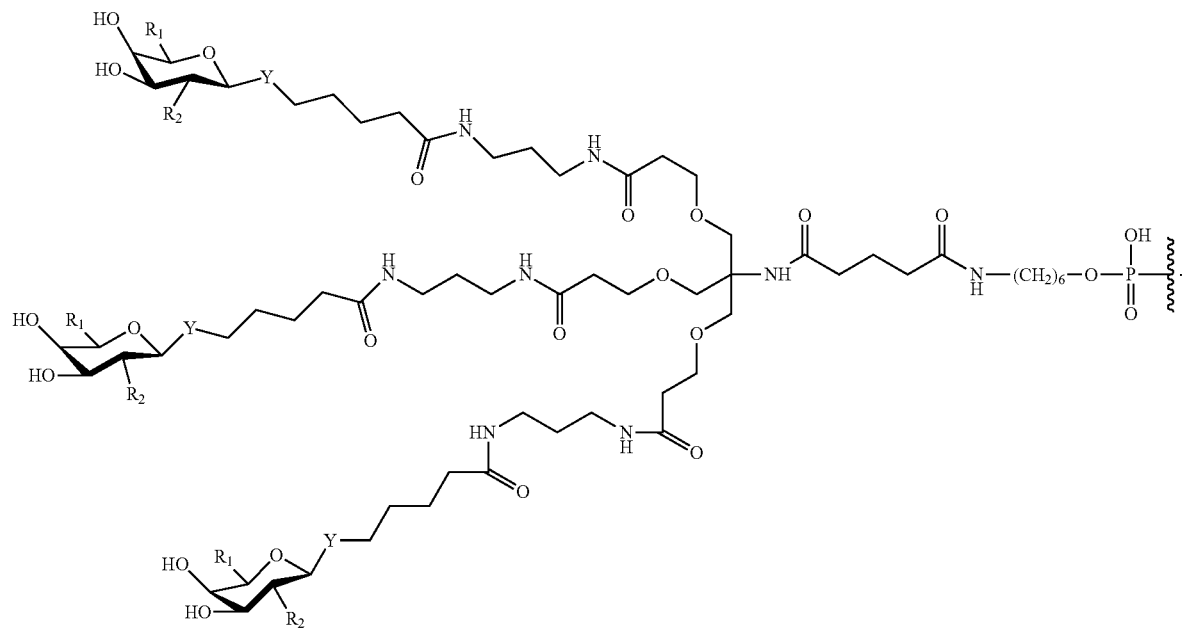
In certain such embodiments, conjugate groups have the following structure:
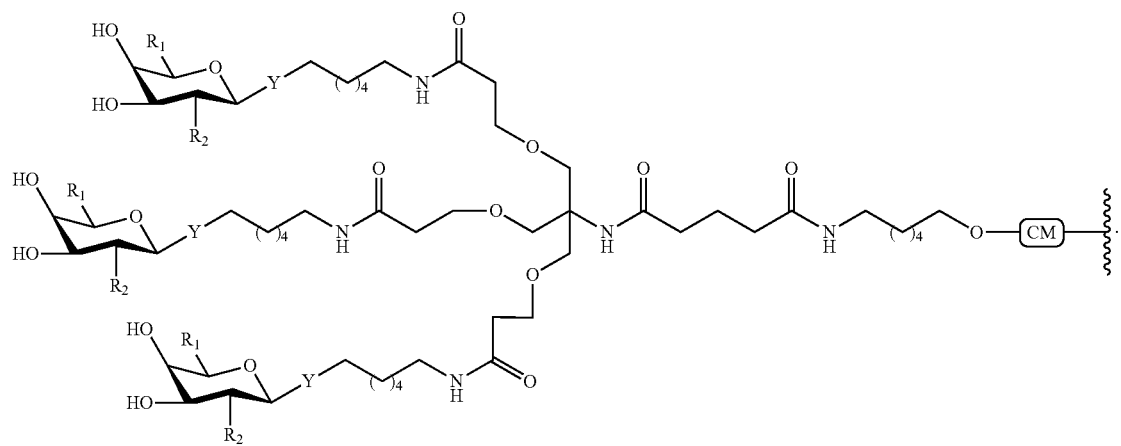
In certain such embodiments, conjugate groups have the following structure:

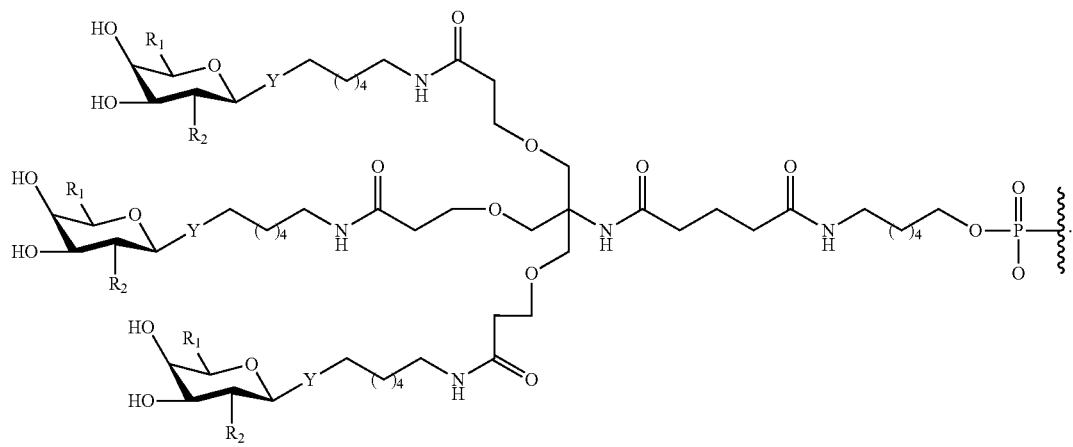
In certain such embodiments, conjugate groups have the following structure:
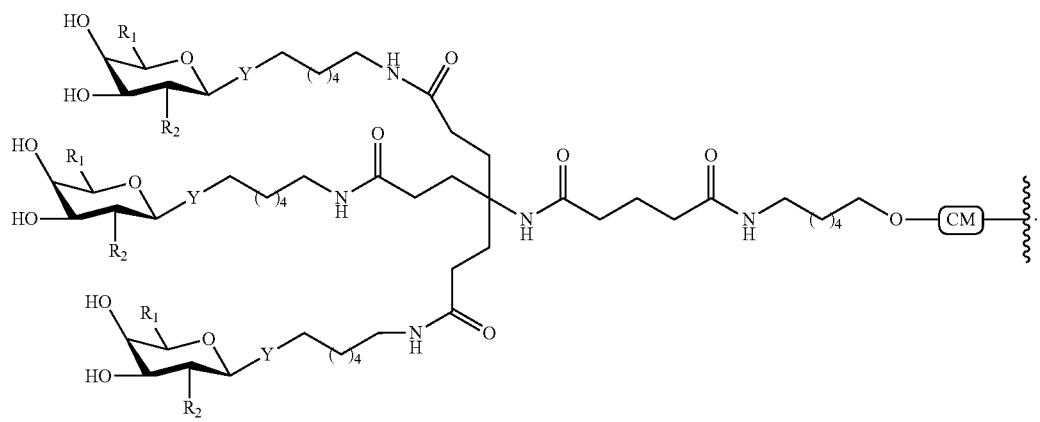
In certain such embodiments, conjugate groups have the following structure:
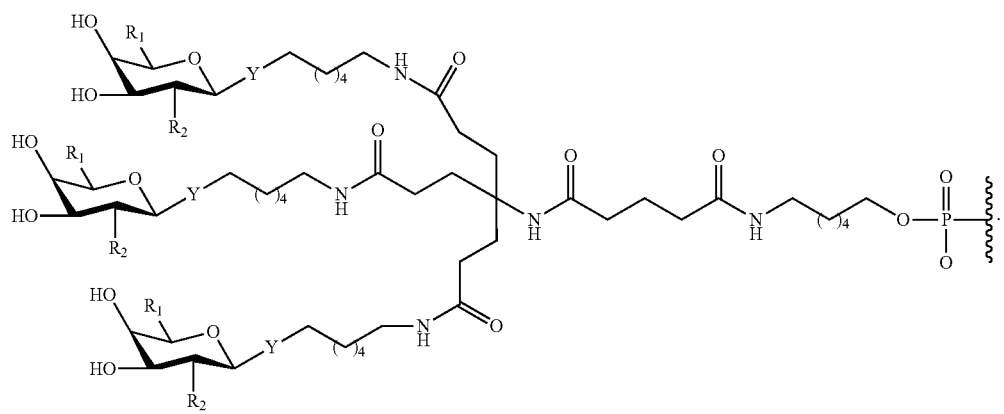
In certain such embodiments, conjugate groups have the following structure:

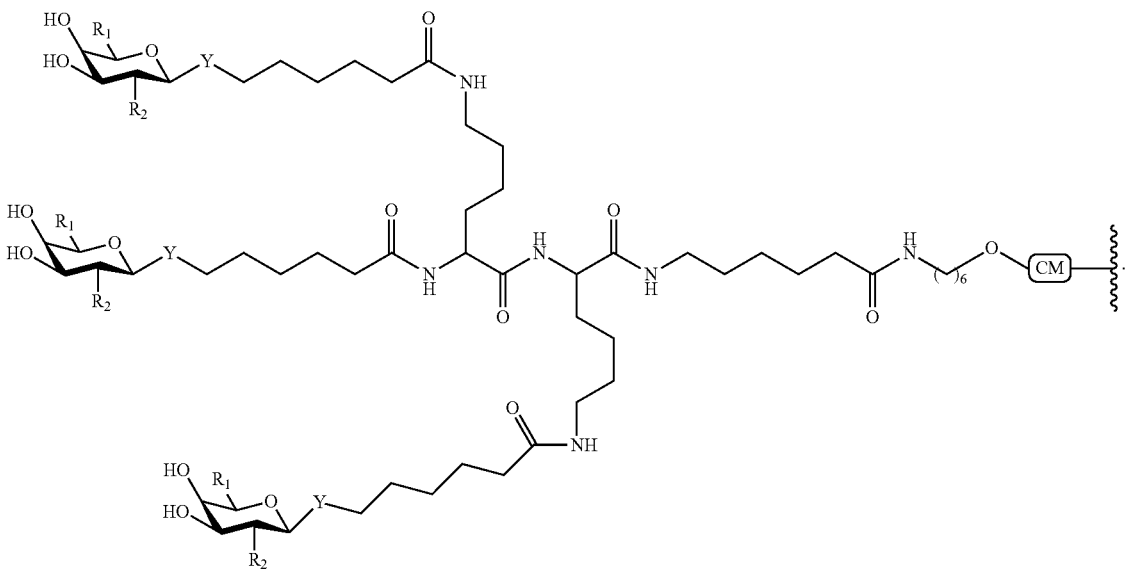
In certain such embodiments, conjugate groups have the following structure:
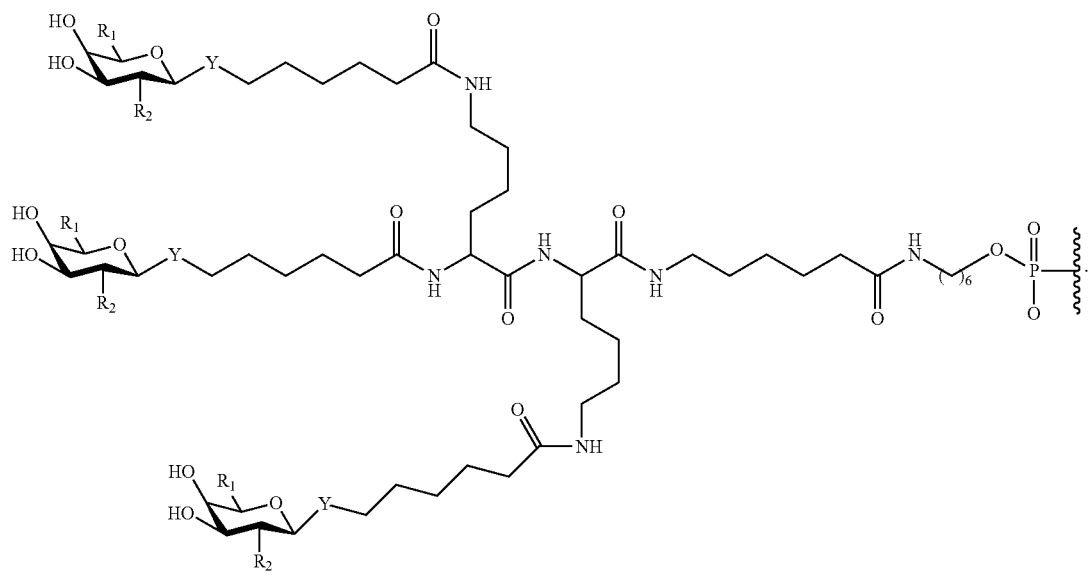
In certain such embodiments, conjugate groups have the following structure:

123

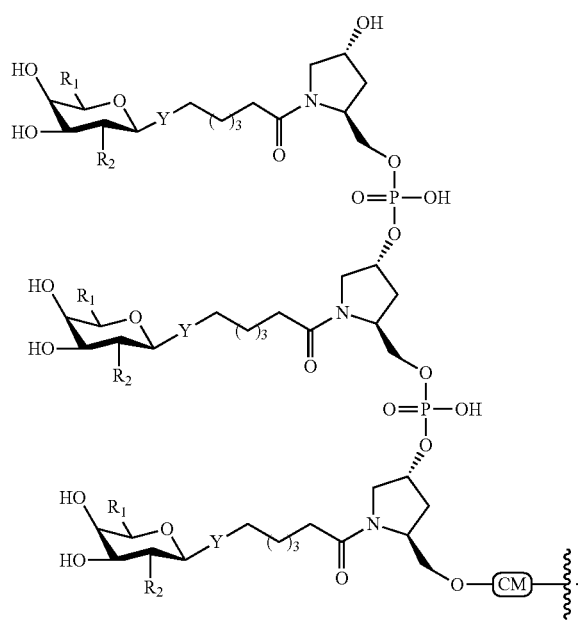

In certain such embodiments, conjugate groups have the following structure:

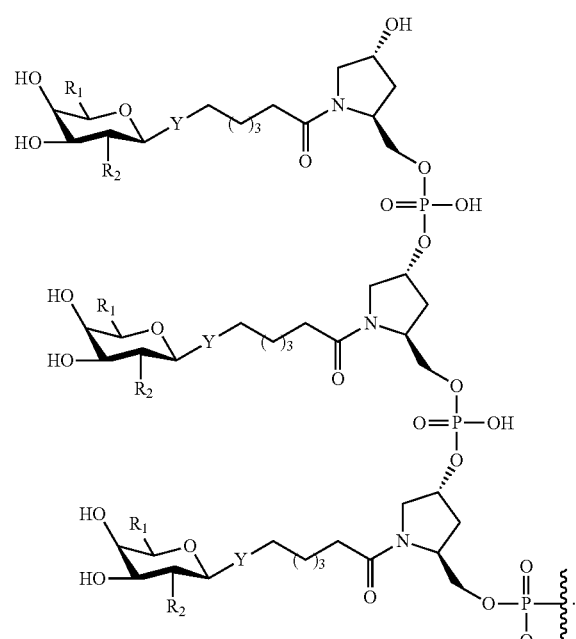

In certain embodiments, the cell-targeting moiety of the conjugate group has the following structure:

124

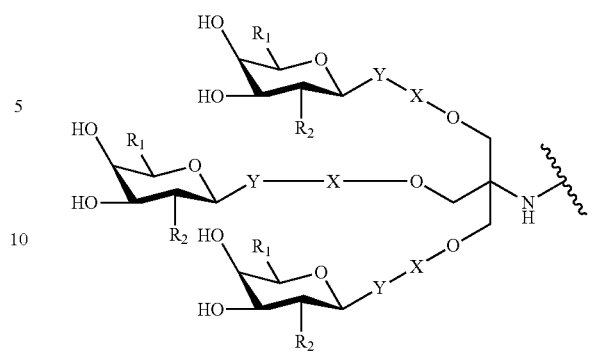

wherein X is a substituted or unsubstituted tether of six to eleven consecutively bonded atoms.

In certain embodiments, the cell-targeting moiety of the conjugate group has the following structure:

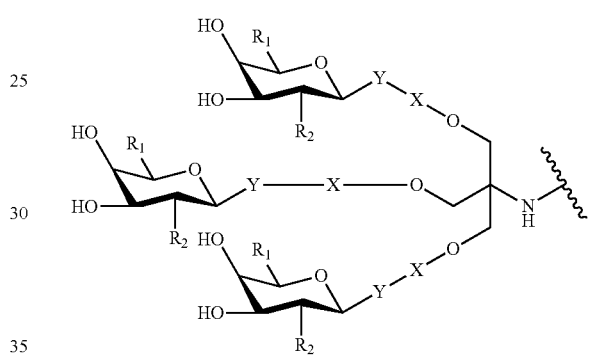

wherein X is a substituted or unsubstituted tether of ten consecutively bonded atoms.

In certain embodiments, the cell-targeting moiety of the conjugate group has the following structure:

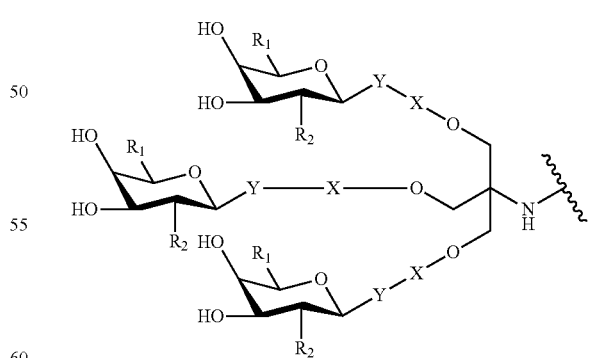

wherein X is a substituted or unsubstituted tether of four to eleven consecutively bonded atoms and wherein the tether comprises exactly one amide bond.

In certain embodiments, the cell-targeting moiety of the conjugate group has the following structure:

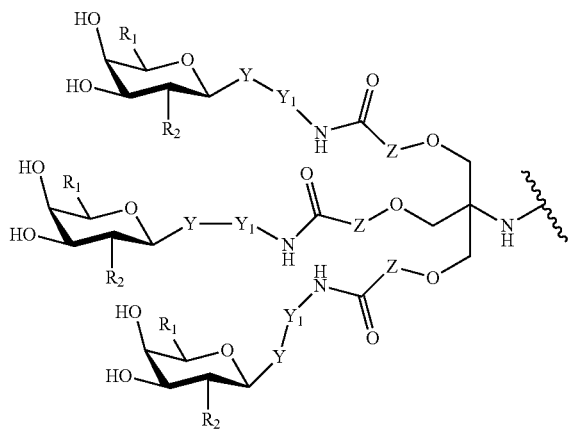

wherein $Y_1$ and Z are independently selected from a $C_1$-$C_{12}$ substituted or unsubstituted alkyl, alkenyl, or alkynyl group, or a group comprising an ether, a ketone, an amide, an ester, a carbamate, an amine, a piperidine, a phosphate, a phosphodiester, a phosphorothioate, a triazole, a pyrrolidine, a disulfide, or a thioether.

In certain such embodiments, the cell-targeting moiety of the conjugate group has the following structure:

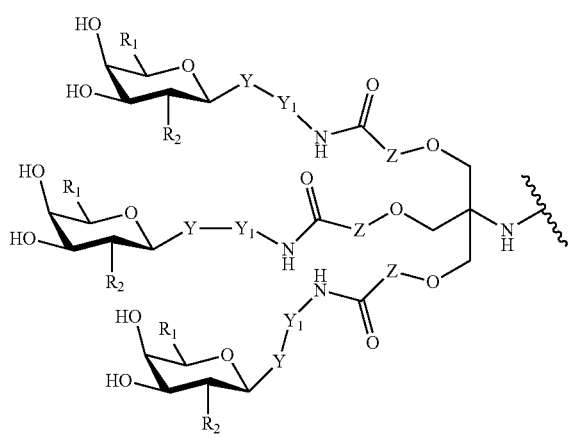

wherein $Y_1$ and Z are independently selected from a $C_1$-$C_{12}$ substituted or unsubstituted alkyl group, or a group comprising exactly one ether or exactly two ethers, an amide, an amine, a piperidine, a phosphate, a phosphodiester, or a phosphorothioate.

In certain such embodiments, the cell-targeting moiety of the conjugate group has the following structure:

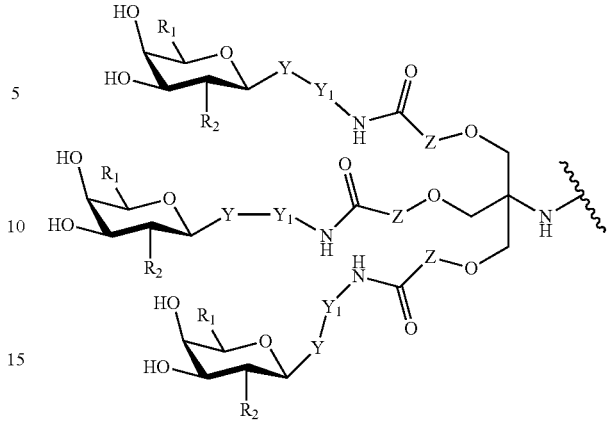

wherein $Y_1$ and Z are independently selected from a $C_1$-$C_{12}$ substituted or unsubstituted alkyl group.

In certain such embodiments, the cell-targeting moiety of the conjugate group has the following structure:

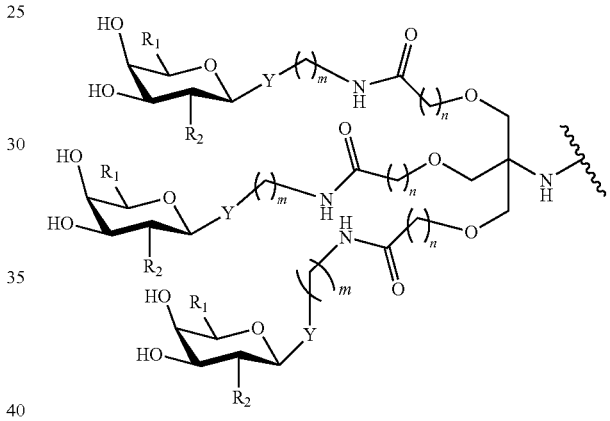

wherein m and n are independently selected from 1, 2, 3, 4, 5, 6, 7, 8, 9, 10, 11, and 12.

In certain such embodiments, the cell-targeting moiety of the conjugate group has the following structure:

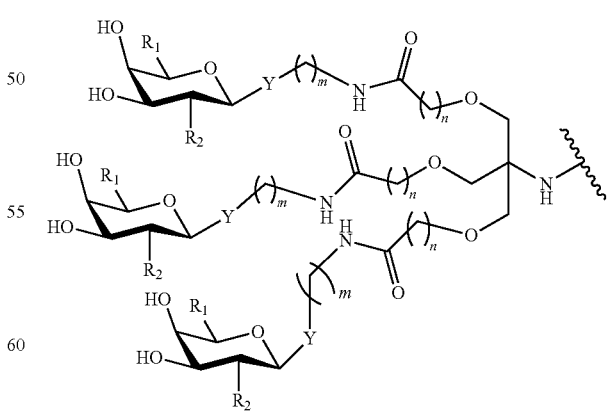

wherein m is 4, 5, 6, 7, or 8, and n is 1, 2, 3, or 4.

In certain embodiments, the cell-targeting moiety of the conjugate group has the following structure:

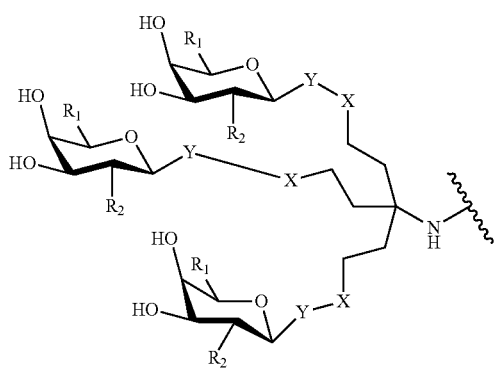

wherein X is a substituted or unsubstituted tether of four to thirteen consecutively bonded atoms, and wherein X does not comprise an ether group.

In certain embodiments, the cell-targeting moiety of the conjugate group has the following structure:

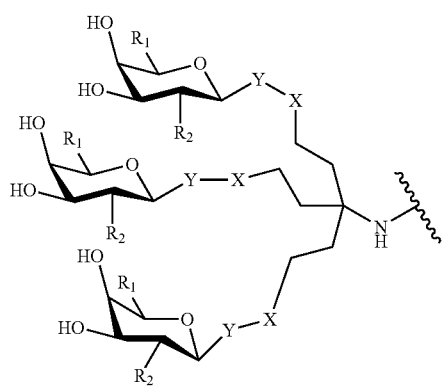

wherein X is a substituted or unsubstituted tether of eight consecutively bonded atoms, and wherein X does not comprise an ether group.

In certain embodiments, the cell-targeting moiety of the conjugate group has the following structure:

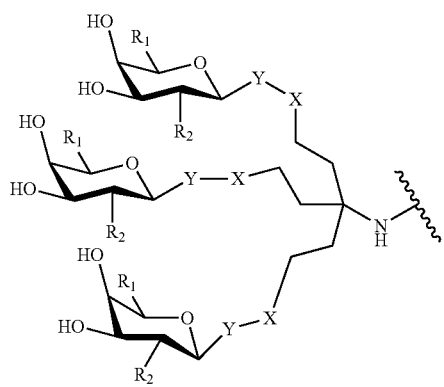

wherein X is a substituted or unsubstituted tether of four to thirteen consecutively bonded atoms, and wherein the tether comprises exactly one amide bond, and wherein X does not comprise an ether group.

In certain embodiments, the cell-targeting moiety of the conjugate group has the following structure:

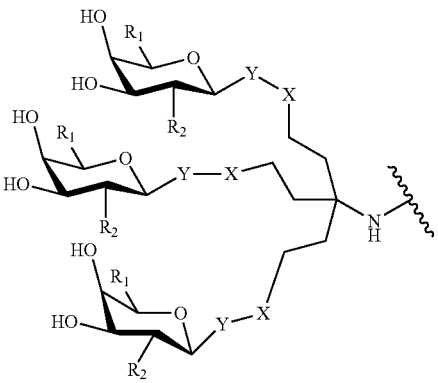

wherein X is a substituted or unsubstituted tether of four to thirteen consecutively bonded atoms and wherein the tether consists of an amide bond and a substituted or unsubstituted $C_2$-$C_{11}$ alkyl group.

In certain embodiments, the cell-targeting moiety of the conjugate group has the following structure:

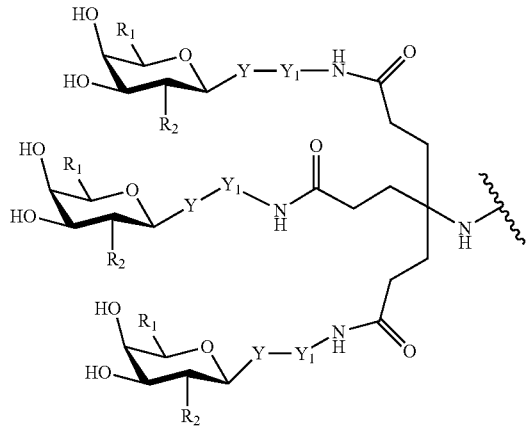

wherein $Y_1$ is selected from a $C_1$-$C_{12}$ substituted or unsubstituted alkyl, alkenyl, or alkynyl group, or a group comprising an ether, a ketone, an amide, an ester, a carbamate, an amine, a piperidine, a phosphate, a phosphodiester, a phosphorothioate, a triazole, a pyrrolidine, a disulfide, or a thioether.

In certain such embodiments, the cell-targeting moiety of the conjugate group has the following structure:

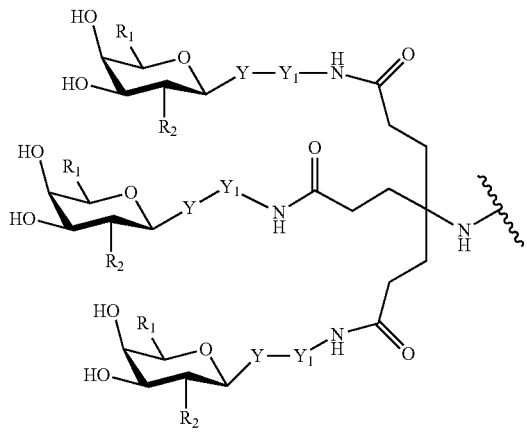

wherein $Y_1$ is selected from a $C_1$-$C_{12}$ substituted or unsubstituted alkyl group, or a group comprising an ether, an amine, a piperidine, a phosphate, a phosphodiester, or a phosphorothioate.

In certain such embodiments, the cell-targeting moiety of the conjugate group has the following structure:

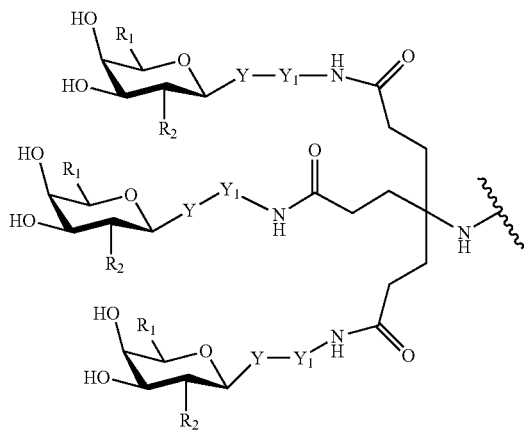

wherein $Y_1$ is selected from a $C_1$-$C_{12}$ substituted or unsubstituted alkyl group.

In certain such embodiments, the cell-targeting moiety of the conjugate group has the following structure:

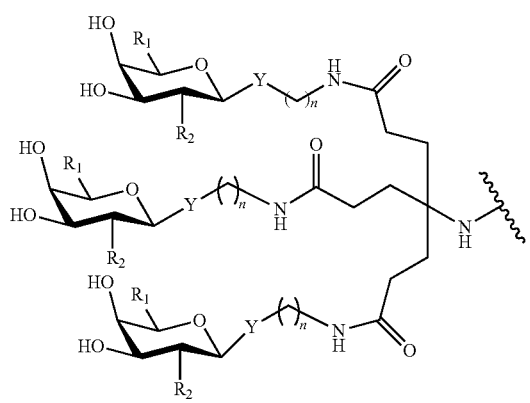

Wherein n is 1, 2, 3, 4, 5, 6, 7, 8, 9, 10, 11, or 12.

In certain such embodiments, the cell-targeting moiety of the conjugate group has the following structure:

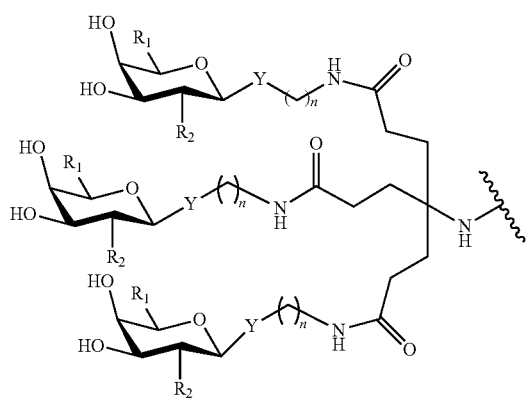

wherein n is 4, 5, 6, 7, or 8.

b. Certain Conjugated Antisense Compounds

In certain embodiments, a compound has a structure selected from among the following:

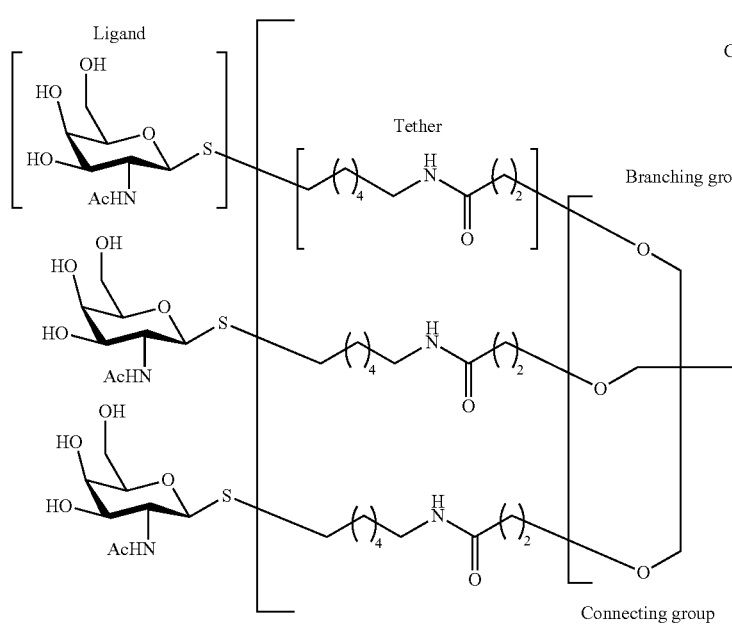 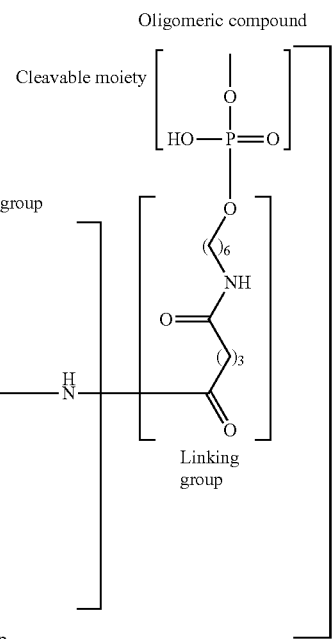

Representative United States patents, United States patent application publications, and international patent application publications that teach the preparation of certain of the above noted conjugates, conjugated antisense compounds, tethers, linkers, branching groups, ligands, cleavable moieties as well as other modifications include without limitation, U.S. Pat. Nos. 5,994,517, 6,300,319, 6,660,720, 6,906,182, 7,262,177, 7,491,805, 8,106,022, 7,723,509, US 2006/0148740, US 2011/0123520, WO 2013/033230 and WO 2012/037254, each of which is incorporated by reference herein in its entirety.

Representative publications that teach the preparation of certain of the above noted conjugates, conjugated antisense compounds, tethers, linkers, branching groups, ligands, cleavable moieties as well as other modifications include without limitation, BIESSEN et al., "The Cholesterol Derivative of a Triantennary Galactoside with High Affinity for the Hepatic Asialoglycoprotein Receptor: a Potent Cholesterol Lowering Agent" J. Med. Chem. (1995) 38:1846-1852, BIESSEN et al., "Synthesis of Cluster Galactosides with High Affinity for the Hepatic Asialoglycoprotein Receptor" J. Med. Chem. (1995) 38:1538-1546, LEE et al., "New and more efficient multivalent glyco-ligands for asialoglycoprotein receptor of mammalian hepatocytes" Bioorganic & Medicinal Chemistry (2011) 19:2494-2500, RENSEN et al., "Determination of the Upper Size Limit for Uptake and Processing of Ligands by the Asialoglycoprotein Receptor on Hepatocytes in Vitro and in Vivo" J. Biol. Chem. (2001) 276(40):37577-37584, RENSEN et al., "Design and Synthesis of Novel N-Acetylgalactosamine-Terminated Glycolipids for Targeting of Lipoproteins to the Hepatic Asialoglycoprotein Receptor" J. Med. Chem. (2004) 47:5798-5808, SLIEDREGT et al., "Design and Synthesis of Novel Amphiphilic Dendritic Galactosides for Selective Targeting of Liposomes to the Hepatic Asialoglycoprotein Receptor" J. Med. Chem. (1999) 42:609-618, and Valentijn et al., "Solid-phase synthesis of lysine-based cluster galactosides with high affinity for the Asialoglycoprotein Receptor" Tetrahedron, 1997, 53(2), 759-770, each of which is incorporated by reference herein in its entirety.

In certain embodiments, conjugated antisense compounds comprise an RNase H based oligonucleotide (such as a gapmer) or a splice modulating oligonucleotide (such as a fully modified oligonucleotide) and any conjugate group comprising at least one, two, or three GalNAc groups. In certain embodiments a conjugated antisense compound comprises any conjugate group found in any of the following references: Lee, Carbohydr Res, 1978, 67, 509-514; Connolly et al., J Biol Chem, 1982, 257, 939-945; Pavia et al., Int J Pep Protein Res, 1983, 22, 539-548; Lee et al., Biochem, 1984, 23, 4255-4261; Lee et al., Glycoconjugate J, 1987, 4, 317-328; Toyokuni et al., Tetrahedron Lett, 1990, 31, 2673-2676; Biessen et al., J Med Chem, 1995, 38, 1538-1546; Valentijn et al., Tetrahedron, 1997, 53, 759-770; Kim et al., Tetrahedron Lett, 1997, 38, 3487-3490; Lee et al., Bioconjug Chem, 1997, 8, 762-765; Kato et al., Glycobiol, 2001, 11, 821-829; Rensen et al., J Biol Chem, 2001, 276, 37577-37584; Lee et al., Methods Enzymol, 2003, 362, 38-43; Westerlind et al., Glycoconj J, 2004, 21, 227-241; Lee et al., Bioorg Med Chem Lett, 2006, 16(19), 5132-5135; Maierhofer et al., Bioorg Med Chem, 2007, 15, 7661-7676; Khorev et al., Bioorg Med Chem, 2008, 16, 5216-5231; Lee et al., Bioorg Med Chem, 2011, 19, 2494-2500; Kornilova et al., Analyt Biochem, 2012, 425, 43-46; Pujol et al., Angew Chemie Int Ed Engl, 2012, 51, 7445-7448; Biessen et al., J Med Chem, 1995, 38, 1846-1852; Sliedregt et al., J Med Chem, 1999, 42, 609-618; Rensen et al., J Med Chem, 2004, 47, 5798-5808; Rensen et al., Arterioscler Thromb Vasc Biol, 2006, 26, 169-175; van Rossenberg et al., Gene Ther, 2004, 11, 457-464; Sato et al., J Am Chem Soc, 2004, 126, 14013-14022; Lee et al., J Org Chem, 2012, 77, 7564-7571; Biessen et al., FASEB J, 2000, 14, 1784-1792; Rajur et al., Bioconjug Chem, 1997, 8, 935-940; Duff et al., Methods Enzymol, 2000, 313, 297-321; Maier et al., Bioconjug Chem, 2003, 14, 18-29; Jayaprakash et al., Org Lett, 2010, 12, 5410-5413; Manoharan, Antisense Nucleic Acid Drug Dev, 2002, 12, 103-128; Merwin et al., Bioconjug Chem, 1994, 5, 612-620; Tomiya et al., Bioorg Med Chem, 2013, 21, 5275-5281; International applications WO1998/013381; WO2011/038356; WO1997/046098; WO2008/098788; WO2004/101619; WO2012/037254; WO2011/120053; WO2011/100131; WO2011/163121; WO2012/177947; WO2013/033230; WO2013/075035; WO2012/083185; WO2012/083046; WO2009/082607; WO2009/134487; WO2010/144740; WO2010/148013; WO1997/020563; WO2010/088537; WO2002/043771; WO2010/129709; WO2012/068187; WO2009/126933; WO2004/024757; WO2010/054406; WO2012/089352; WO2012/089602; WO2013/166121; WO2013/165816; U.S. Pat. Nos. 4,751,219; 8,552,163; 6,908,903; 7,262,177; 5,994,517; 6,300,319; 8,106,022; 7,491,805; 7,491,805; 7,582,744; 8,137,695; 6,383,812; 6,525,031; 6,660,720; 7,723,509; 8,541,548; 8,344,125; 8,313,772; 8,349,308; 8,450,467; 8,501,930; 8,158,601; 7,262,177; 6,906,182; 6,620,916; 8,435,491; 8,404,862; 7,851,615; Published U.S. Patent Application Publications US2011/0097264; US2011/0097265; US2013/0004427; US2005/0164235; US2006/0148740; US2008/0281044; US2010/0240730; US2003/0119724; US2006/0183886; US2008/0206869; US2011/0269814; US2009/0286973; US2011/0207799; US2012/0136042; US2012/0165393; US2008/0281041; US2009/0203135; US2012/0035115; US2012/0095075; US2012/0101148; US2012/0128760; US2012/0157509; US2012/0230938; US2013/0109817; US2013/0121954; US2013/0178512; US2013/0236968; US2011/0123520; US2003/0077829; US2008/0108801; and US2009/0203132; each of which is incorporated by reference in its entirety.

C. Certain Uses and Features

In certain embodiments, conjugated antisense compounds exhibit potent target RNA reduction in vivo. In certain embodiments, unconjugated antisense compounds accumulate in the kidney. In certain embodiments, conjugated antisense compounds accumulate in the liver. In certain embodiments, conjugated antisense compounds are well tolerated. Such properties render conjugated antisense compounds particularly useful for inhibition of many target RNAs, including, but not limited to those involved in metabolic, cardiovascular and other diseases, disorders or conditions. Thus, provided herein are methods of treating such diseases, disorders or conditions by contacting liver tissues with the conjugated antisense compounds targeted to RNAs associated with such diseases, disorders or conditions. Thus, also provided are methods for ameliorating any of a variety of metabolic, cardiovascular and other diseases, disorders or conditions with the conjugated antisense compounds of the present invention.

In certain embodiments, conjugated antisense compounds are more potent than unconjugated counterpart at a particular tissue concentration. Without wishing to be bound by any theory or mechanism, in certain embodiments, the conjugate may allow the conjugated antisense compound to enter the cell more efficiently or to enter the cell more productively. For example, in certain embodiments conjugated antisense compounds may exhibit greater target reduction as compared to its unconjugated counterpart wherein both the conjugated antisense compound and its unconjugated counterpart are present in the tissue at the same concentrations. For example, in certain embodiments conjugated antisense compounds may exhibit greater target reduction as compared to its unconjugated counterpart wherein both the conjugated antisense compound and its unconjugated counterpart are present in the liver at the same concentrations.

The in vivo data in examples 18 and 19 includes $ED_{50}$ values for several oligomeric compounds, each comprising the same oligonucleotide targeted to SRB-l and one of several different conjugates. As shown below, the conjugate groups in these assays included: (1) $GalNAc_3$-$7_a$ (a 3-sugar GalNAc conjugate group); (2) MP-Triazole-$GalNAc_3$-7a, also referred to herein as $GalNAc_3$-$33_a$ (the same 3-sugar conjugate group as $GalNAc_3$-$7_a$, but with a triazole modification on each GalNAc sugar); (3) $GalNAc_1$-$25_a$ (a 1-sugar GalNAc conjugate group); and (4) $GalNAc_1$-$34_a$ (a 1-sugar GalNAc conjugate that is an analog of $GalNAc_1$-$25_a$ with a triazole modification on the one GalNac sugar). Structures of $GalNAc_3$-$7_a$ and $GalNAc_1$-$25_a$ are shown below. Structures of $GalNAc_3$-$33_a$ and $GalNAc_1$-$34_a$ are shown in compounds 63 (wherein n=6) and 68a (wherein n=6) in Examples 8 and 9, respectively.

In these assays, the unmodified 1-sugar GalNAc conjugate (3) was less active than the 3-sugar unmodified GalNac conjugate (1). Thus, in these assays going from 3 sugars to 1 sugar resulted in a slight decrease in activity. Adding the triazole modification to the 3-sugar unmodified GalNac conjugate (2) did not result in significant additional activity when compared to the unmodified 3-sugar GalNAc conjugate (1). However, the triazole modification on the 1-sugar GalNAc conjugate resulted improved activity compared to the same 1-sugar conjugate lacking the triazole (3). In fact, the triazole-modified 1-sugar GalNAc conjugate had activity comparable to (and perhaps even better than) that of the 3-sugar conjugates. Thus, in these assays, triazole modification of the GalNAc sugar restored the loss of activity observed in reducing the number of sugars in the conjugate from 3 to 1.

| ISIS No. | $ED_{50}$/# | Chemistry (no cleavable nucleoside) | Sugar(s) |
|---|---|---|---|
| 702489/142 | 3.4/(1) | $GalNAc_3$-$7_a$ | 3 |
| 721456/142 | 3.7/(2) | MP-Triazole-$GalNAc_3$-$7_a$ ($GalNAc_3$-$33_a$) | 3 (modified) |
| 711462/142 | 4.9/(3) | $GalNAc_1$-$25_a$ | 1 |
| 1727852/142 | 2.9/(4) | $GalNAc_1$-$34_a$ | 1 (modified) |

The structure of GalNAc$_3$-7$_a$ is:

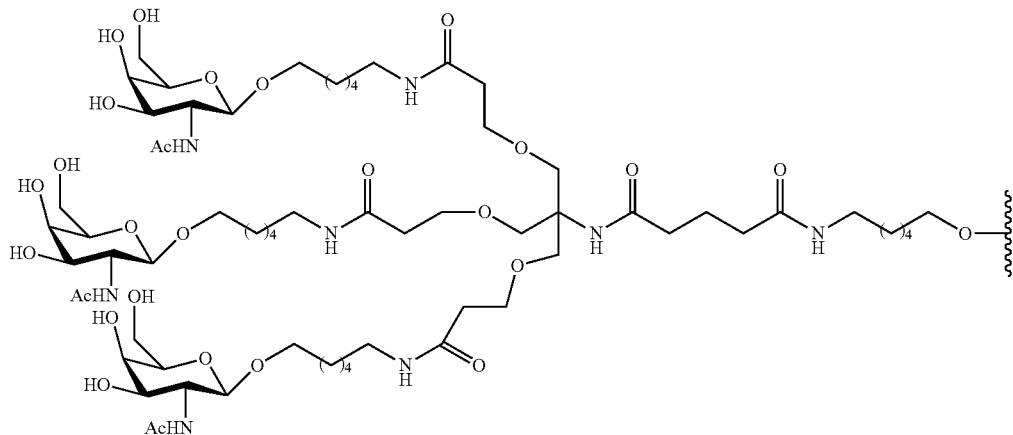

The structure of GalNAc$_1$-25$_a$ is:

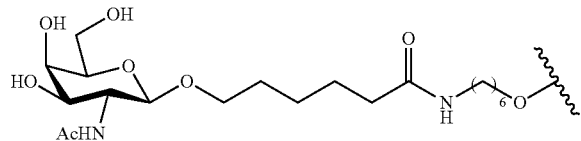

Productive and non-productive uptake of oligonucleotides has been discussed previously (See e.g. Geary, R. S., E. Wancewicz, et al. (2009). "Effect of Dose and Plasma Concentration on Liver Uptake and Pharmacologic Activity of a 2'-Methoxyethyl Modified Chimeric Antisense Oligonucleotide Targeting PTEN." Biochem. Pharmacol. 78(3): 284-91; & Koller, E., T. M. Vincent, et al. (2011). "Mechanisms of single-stranded phosphorothioate modified antisense oligonucleotide accumulation in hepatocytes." Nucleic Acids Res. 39(11): 4795-807). Conjugate groups described herein may improve productive uptake.

In certain embodiments, the conjugate groups described herein may further improve potency by increasing the affinity of the conjugated antisense compound for a particular type of cell or tissue. In certain embodiments, the conjugate groups described herein may further improve potency by increasing recognition of the conjugated antisense compound by one or more cell-surface receptors. In certain embodiments, the conjugate groups described herein may further improve potency by facilitating endocytosis of the conjugated antisense compound.

In certain embodiments, the cleavable moiety may further improve potency by allowing the conjugate to be cleaved from the antisense oligonucleotide after the conjugated antisense compound has entered the cell. Accordingly, in certain embodiments, conjugated antisense compounds can be administered at doses lower than would be necessary for unconjugated antisense oligonucleotides.

Phosphorothioate linkages have been incorporated into antisense oligonucleotides previously. Such phosphorothioate linkages are resistant to nucleases and so improve stability of the oligonucleotide. Further, phosphorothioate linkages also bind certain proteins, which results in accumulation of antisense oligonucleotide in the liver. Oligonucleotides with fewer phosphorothioate linkages accumulate less in the liver and more in the kidney (see, for example, Geary, R., "Pharmacokinetic Properties of 2'-O-(2-Methoxyethyl)-Modified Oligonucleotide Analogs in Rats," Journal of Pharmacology and Experimental Therapeutics, Vol. 296, No. 3, 890-897; & Pharmacological Properties of 2'-O-Methoxyethyl Modified Oligonucleotides in Antisense a Drug Technology, Chapter 10, Crooke, S. T., ed., 2008) In certain embodiments, oligonucleotides with fewer phosphorothioate internucleoside linkages and more phosphodiester internucleoside linkages accumulate less in the liver and more in the kidney. When treating diseases in the liver, this is undesirable for several reasons (1) less drug is getting to the site of desired action (liver); (2) drug is escaping into the urine; and (3) the kidney is exposed to relatively high concentration of drug which can result in toxicities in the kidney. Thus, for liver diseases, phosphorothioate linkages provide important benefits.

In certain embodiments, however, administration of oligonucleotides uniformly linked by phosphorothioate internucleoside linkages induces one or more proinflammatory reactions. (see for example: J Lab Clin Med. 1996 September; 128(3):329-38. "Amplification of antibody production by phosphorothioate oligodeoxynucleotides". Branda et al.; and see also for example: Toxicologic Properties in Antisense a Drug Technology, Chapter 12, pages 342-351, Crooke, S. T., ed., 2008). In certain embodiments, administration of oligonucleotides wherein most of the internucleoside linkages comprise phosphorothioate internucleoside linkages induces one or more proinflammatory reactions.

In certain embodiments, the degree of proinflammatory effect may depend on several variables (e.g. backbone modification, off-target effects, nucleobase modifications, and/or nucleoside modifications) see for example: Toxicologic Properties in Antisense a Drug Technology, Chapter 12, pages 342-351, Crooke, S. T., ed., 2008). In certain embodiments, the degree of proinflammatory effect may be mitigated by adjusting one or more variables. For example the degree of proinflammatory effect of a given oligonucleotide may be mitigated by replacing any number of phosphorothioate internucleoside linkages with phosphodiester internucleoside linkages and thereby reducing the total number of phosphorothioate internucleoside linkages.

In certain embodiments, it would be desirable to reduce the number of phosphorothioate linkages, if doing so could be done without losing stability and without shifting the distribution from liver to kidney. For example, in certain embodiments, the number of phosphorothioate linkages may be reduced by replacing phosphorothioate linkages with phosphodiester linkages. In such an embodiment, the antisense compound having fewer phosphorothioate linkages and more phosphodiester linkages may induce less proinflammatory reactions or no proinflammatory reaction. Although the antisense compound having fewer phosphorothioate linkages and more phosphodiester linkages may induce fewer proinflammatory reactions, the antisense compound having fewer phosphorothioate linkages and more phosphodiester linkages may not accumulate in the liver and may be less efficacious at the same or similar dose as compared to an antisense compound having more phosphorothioate linkages. In certain embodiments, it is therefore desirable to design an antisense compound that has a plurality of phosphodiester bonds and a plurality of phosphorothioate bonds but which also possesses stability and good distribution to the liver.

In certain embodiments, conjugated antisense compounds accumulate more in the liver and less in the kidney than unconjugated counterparts, even when some of the phosphorothioate linkages are replaced with less proinflammatory phosphodiester internucleoside linkages. In certain embodiments, conjugated antisense compounds accumulate more in the liver and are not excreted as much in the urine compared to its unconjugated counterparts, even when some of the phosphorothioate linkages are replaced with less proinflammatory phosphodiester internucleoside linkages. In certain embodiments, the use of a conjugate allows one to design more potent and better tolerated antisense drugs. Indeed, in certain embodiments, conjugated antisense compounds have larger therapeutic indexes than unconjugated counterparts. This allows the conjugated antisense compound to be administered at a higher absolute dose, because there is less risk of proinflammatory response and less risk of kidney toxicity. This higher dose, allows one to dose less frequently, since the clearance (metabolism) is expected to be similar. Further, because the compound is more potent, as described above, one can allow the concentration to go lower before the next dose without losing therapeutic activity, allowing for even longer periods between dosing.

In certain embodiments, the inclusion of some phosphorothioate linkages remains desirable. For example, the terminal linkages are vulnerable to exonucleases and so in certain embodiments, those linkages are phosphorothioate or other modified linkage. Internucleoside linkages linking two deoxynucleosides are vulnerable to endonucleases and so in certain embodiments those linkages are phosphorothioate or other modified linkage. Internucleoside linkages between a modified nucleoside and a deoxynucleoside where the deoxynucleoside is on the 5' side of the linkage deoxynucleosides are vulnerable to endonucleases and so in certain embodiments those linkages are phosphorothioate or other modified linkage. Internucleoside linkages between two modified nucleosides of certain types and between a deoxynucleoside and a modified nucleoside of certain type where the modified nucleoside is at the 5' side of the linkage are sufficiently resistant to nuclease digestion, that the linkage can be phosphodiester.

In certain embodiments, the antisense oligonucleotide of a conjugated antisense compound comprises fewer than 16 phosphorothioate linkages. In certain embodiments, the antisense oligonucleotide of a conjugated antisense compound comprises fewer than 15 phosphorothioate linkages. In certain embodiments, the antisense oligonucleotide of a conjugated antisense compound comprises fewer than 14 phosphorothioate linkages. In certain embodiments, the antisense oligonucleotide of a conjugated antisense compound comprises fewer than 13 phosphorothioate linkages. In certain embodiments, the antisense oligonucleotide of a conjugated antisense compound comprises fewer than 12 phosphorothioate linkages. In certain embodiments, the antisense oligonucleotide of a conjugated antisense compound comprises fewer than 11 phosphorothioate linkages. In certain embodiments, the antisense oligonucleotide of a conjugated antisense compound comprises fewer than 10 phosphorothioate linkages. In certain embodiments, the antisense oligonucleotide of a conjugated antisense compound comprises fewer than 9 phosphorothioate linkages. In certain embodiments, the antisense oligonucleotide of a conjugated antisense compound comprises fewer than 8 phosphorothioate linkages.

In certain embodiments, antisense compounds comprising one or more conjugate group described herein has increased activity and/or potency and/or tolerability compared to a parent antisense compound lacking such one or more conjugate group. Accordingly, in certain embodiments, attachment of such conjugate groups to an oligonucleotide is desirable. Such conjugate groups may be attached at the 5'-, and/or 3'-end of an oligonucleotide. In certain instances, attachment at the 5'-end is synthetically desirable. Typically, oligonucleotides are synthesized by attachment of the 3' terminal nucleoside to a solid support and sequential coupling of nucleosides from 3' to 5' using techniques that are well known in the art. Accordingly if a conjugate group is desired at the 3'-terminus, one may (1) attach the conjugate group to the 3'-terminal nucleoside and attach that conjugated nucleoside to the solid support for subsequent preparation of the oligonucleotide or (2) attach the conjugate group to the 3'-terminal nucleoside of a completed oligonucleotide after synthesis. Neither of these approaches is very efficient and thus both are costly. In particular, attachment of the conjugated nucleoside to the solid support, while demonstrated in the Examples herein, is an inefficient process. In certain embodiments, attaching a conjugate group to the 5'-terminal nucleoside is synthetically easier than attachment at the 3'-end. One may attach a non-conjugated 3' terminal nucleoside to the solid support and prepare the oligonucleotide using standard and well characterized reactions. One then needs only to attach a 5'nucleoside having a conjugate group at the final coupling step. In certain embodiments, this is more efficient than attaching a conjugated nucleoside directly to the solid support as is typically done to prepare a 3'-conjugated oligonucleotide. The Examples herein demonstrate attachment at the 5'-end. In addition, certain conjugate groups have synthetic advantages. For Example, certain conjugate groups comprising phosphorus linkage groups are synthetically simpler and more efficiently prepared than other conjugate groups, including conjugate groups reported previously (e.g., WO/2012/037254).

In certain embodiments, conjugated antisense compounds are administered to a subject. In such embodiments, antisense compounds comprising one or more conjugate group described herein has increased activity and/or potency and/or tolerability compared to a parent antisense compound lacking such one or more conjugate group. Without being bound by mechanism, it is believed that the conjugate group helps with distribution, delivery, and/or uptake into a target cell or tissue. In certain embodiments, once inside the target cell or tissue, it is desirable that all or part of the conjugate group to be cleaved to release the active oligonucleotide. In certain embodiments, it is not necessary that the entire conjugate group be cleaved from the oligonucleotide. For example, in Example 17 a conjugated oligonucleotide was administered to mice and a number of different chemical species, each comprising a different portion of the conjugate group remaining on the oligonucleotide, were detected (Table 28). This conjugated antisense compound demonstrated good potency (Table 29). Thus, in certain embodiments, such metabolite profile of multiple partial cleavage of the conjugate group does not interfere with activity/potency. Nevertheless, in certain embodiments it is desirable that a prodrug (conjugated oligonucleotide) yield a single active compound. In certain instances, if multiple forms of the active compound are found, it may be necessary to determine relative amounts and activities for each one. In certain embodiments where regulatory review is required (e.g., USFDA or counterpart) it is desirable to have a single (or predominantly single) active species. In certain such embodiments, it is desirable that such single active species be the antisense oligonucleotide lacking any portion of the conjugate group. In certain embodiments, conjugate groups at the 5'-end are more likely to result in complete metabolism of the conjugate group. Without being bound by mechanism it may be that endogenous enzymes responsible for metabolism at the 5' end (e.g., 5' nucleases) are more active/efficient than the 3' counterparts. In certain embodiments, the specific conjugate groups are more amenable to metabolism to a single active species. In certain embodiments, certain conjugate groups are more amenable to metabolism to the oligonucleotide.

D. Antisense

In certain embodiments, oligomeric compounds of the present invention are antisense compounds. In such embodiments, the oligomeric compound is complementary to a target nucleic acid. In certain embodiments, a target nucleic acid is an RNA. In certain embodiments, a target nucleic acid is a non-coding RNA. In certain embodiments, a target nucleic acid encodes a protein. In certain embodiments, a target nucleic acid is selected from a mRNA, a pre-mRNA, a microRNA, a non-coding RNA, including small non-coding RNA, and a promoter-directed RNA. In certain embodiments, oligomeric compounds are at least partially complementary to more than one target nucleic acid. For example, oligomeric compounds of the present invention may be microRNA mimics, which typically bind to multiple targets.

In certain embodiments, antisense compounds comprise a portion having a nucleobase sequence at least 70% complementary to the nucleobase sequence of a target nucleic acid. In certain embodiments, antisense compounds comprise a portion having a nucleobase sequence at least 80% complementary to the nucleobase sequence of a target nucleic acid. In certain embodiments, antisense compounds comprise a portion having a nucleobase sequence at least 90% complementary to the nucleobase sequence of a target nucleic acid. In certain embodiments, antisense compounds comprise a portion having a nucleobase sequence at least 95% complementary to the nucleobase sequence of a target nucleic acid. In certain embodiments, antisense compounds comprise a portion having a nucleobase sequence at least 98% complementary to the nucleobase sequence of a target nucleic acid. In certain embodiments, antisense compounds comprise a portion having a nucleobase sequence that is 100% complementary to the nucleobase sequence of a target nucleic acid. In certain embodiments, antisense compounds are at least 70%, 80%, 90%, 95%, 98%, or 100% complementary to the nucleobase sequence of a target nucleic acid over the entire length of the antisense compound.

Antisense mechanisms include any mechanism involving the hybridization of an oligomeric compound with target nucleic acid, wherein the hybridization results in a biological effect. In certain embodiments, such hybridization results in either target nucleic acid degradation or occupancy with concomitant inhibition or stimulation of the cellular machinery involving, for example, translation, transcription, or polyadenylation of the target nucleic acid or of a nucleic acid with which the target nucleic acid may otherwise interact.

One type of antisense mechanism involving degradation of target RNA is RNase H mediated antisense. RNase H is a cellular endonuclease which cleaves the RNA strand of an RNA:DNA duplex. It is known in the art that single-stranded antisense compounds which are "DNA-like" elicit RNase H activity in mammalian cells. Activation of RNase H, therefore, results in cleavage of the RNA target, thereby greatly enhancing the efficiency of DNA-like oligonucleotide-mediated inhibition of gene expression.

Antisense mechanisms also include, without limitation RNAi mechanisms, which utilize the RISC pathway. Such RNAi mechanisms include, without limitation siRNA, ssRNA and microRNA mechanisms. Such mechanisms include creation of a microRNA mimic and/or an anti-microRNA.

Antisense mechanisms also include, without limitation, mechanisms that hybridize or mimic non-coding RNA other than microRNA or mRNA. Such non-coding RNA includes, but is not limited to promoter-directed RNA and short and long RNA that effects transcription or translation of one or more nucleic acids.

In certain embodiments, oligonucleotides comprising conjugates described herein are RNAi compounds. In certain embodiments, oligomeric oligonucleotides comprising conjugates described herein are ssRNA compounds. In certain embodiments, oligonucleotides comprising conjugates described herein are paired with a second oligomeric compound to form an siRNA. In certain such embodiments, the second oligomeric compound also comprises a conjugate. In certain embodiments, the second oligomeric compound is any modified or unmodified nucleic acid. In certain embodiments, the oligonucleotides comprising conjugates described herein is the antisense strand in an siRNA compound. In certain embodiments, the oligonucleotides comprising conjugates described herein is the sense strand in an siRNA compound. In embodiments in which the conjugated oligomeric compound is double-stranded siRNA, the conjugate may be on the sense strand, the antisense strand or both the sense strand and the antisense strand.

D. Target Nucleic Acids, Regions and Segments

In certain embodiments, conjugated antisense compounds target any nucleic acid. In certain embodiments, the target nucleic acid encodes a target protein that is clinically relevant. In such embodiments, modulation of the target nucleic acid results in clinical benefit. Certain target nucleic acids include, but are not limited to, the target nucleic acids illustrated in Table 1.

TABLE 1

Certain Target Nucleic Acids

| Target | Species | GENBANK ® Accession Number | SEQ ID NO |
|---|---|---|---|
| Androgen Receptor (AR) | Human | NT_011669.17 truncated from nucleobases 5079000 to 5270000 | 1 |
| Apolipoprotein (a) (Apo(a)) | Human | NM_005577.2 | 2 |
| Apolipoprotein B (ApoB) | Human | NM_000384.1 | 3 |
| Apolipoprotein C-III (ApoCIII) | Human | NT_033899.8 truncated from nucleobases 20262640 to 20266603 | 4 |
| Apolipoprotein C-III (ApoCIII) | Human | NM_000040.1 | 5 |
| C-Reactive Protein (CRP) | Human | M11725.1 | 6 |
| eIF4E | Human | M15353.1 | 7 |
| Factor VII | Human | NT_027140.6 truncated from nucleobases 1255000 to 1273000 | 8 |
| Factor XI | Human | NM_000128.3 | 9 |
| Glucocorticoid Receptor (GCCR) | Human | the compleme NT_029289.10 truncated from nucleobases 3818000 to 3980000 | 10 |
| Glucagon Receptor (GCGR) | Human | NW_926918.1 truncated from nucleobases 16865000 to 16885000 | 11 |
| HBV | Human | U95551.1 | 12 |
| Protein Tyrosine Phosphatase 1B (PTP1B) | Human | NM_002827.2 | 13 |
| Protein Tyrosine Phosphatase 1B (PTP1B) | Human | NT_011362.9 truncated from nucleobases 14178000 to 14256000 | 14 |
| STAT3 | Human | NM_139276.2 | 15 |
| Transthyretin (TTR) | Human | NM_000371.3 | 16 |

The targeting process usually includes determination of at least one target region, segment, or site within the target nucleic acid for the antisense interaction to occur such that the desired effect will result.

In certain embodiments, a target region is a structurally defined region of the nucleic acid. For example, in certain such embodiments, a target region may encompass a 3' UTR, a 5' UTR, an exon, an intron, a coding region, a translation initiation region, translation termination region, or other defined nucleic acid region or target segment.

In certain embodiments, a target segment is at least about an 8-nucleobase portion of a target region to which a conjugated antisense compound is targeted. Target segments can include DNA or RNA sequences that comprise at least 8 consecutive nucleobases from the 5'-terminus of one of the target segments (the remaining nucleobases being a consecutive stretch of the same DNA or RNA beginning immediately upstream of the 5'-terminus of the target segment and continuing until the DNA or RNA comprises about 8 to about 30 nucleobases). Target segments are also represented by DNA or RNA sequences that comprise at least 8 consecutive nucleobases from the 3'-terminus of one of the target segments (the remaining nucleobases being a consecutive stretch of the same DNA or RNA beginning immediately downstream of the 3'-terminus of the target segment and continuing until the DNA or RNA comprises about 8 to about 30 nucleobases). Target segments can also be represented by DNA or RNA sequences that comprise at least 8 consecutive nucleobases from an internal portion of the sequence of a target segment, and may extend in either or both directions until the conjugated antisense compound comprises about 8 to about 30 nucleobases.

In certain embodiments, antisense compounds targeted to the nucleic acids listed in Table 1 can be modified as described herein. In certain embodiments, the antisense compounds can have a modified sugar moiety, an unmodified sugar moiety or a mixture of modified and unmodified sugar moieties as described herein. In certain embodiments, the antisense compounds can have a modified internucleoside linkage, an unmodified internucleoside linkage or a mixture of modified and unmodified internucleoside linkages as described herein. In certain embodiments, the antisense compounds can have a modified nucleobase, an unmodified nucleobase or a mixture of modified and unmodified nucleobases as described herein. In certain embodiments, the antisense compounds can have a motif as described herein.

In certain embodiments, antisense compounds targeted to the nucleic acids listed in Table 1 can be conjugated as described herein.

1. Androgen Receptor (AR)

AR is a transcription factor implicated as a driver of prostate cancer. AR is activated by binding to its hormone ligands: androgen, testosterone, and/or DHT. Androgen deprivation therapy, also known as "chemical castration," is a first-line treatment strategy against hormone-sensitive, androgen-dependent prostate cancer that reduces circulating androgen levels and thereby inhibits AR activity. However, androgen deprivation therapy frequently leads to the emergence and growth of "castration-resistant" advanced prostate cancer, in which AR signaling is reactivated independent of ligand binding. The mechanisms underlying castration resistance in advanced prostate cancer remain unclear.

Certain Conjugated Antisense Compounds Targeted to an AR Nucleic Acid

In certain embodiments, conjugated antisense compounds are targeted to an AR nucleic acid having the sequence of GENBANK® Accession No. NT_011669.17 nucleobases 5079000 to 5270000, incorporated herein as SEQ ID NO: 1. In certain such embodiments, a conjugated antisense compound is at least 90%, at least 95%, or 100% complementary to SEQ ID NO: 1.

In certain embodiments, a conjugated antisense compound targeted to SEQ ID NO: 1 comprises an at least 8 consecutive nucleobase sequence selected from the nucleobase sequence of any of SEQ ID NOs: 17-24. In certain embodiments, a conjugated antisense compound targeted to SEQ ID NO: 1 comprises a nucleobase sequence selected from the nucleobase sequence of any of SEQ ID NOs:

17-24. In certain embodiments, such conjugated antisense compounds comprise a conjugate comprising 1-3 GalNAc ligands. In certain embodiments, such antisense compounds comprise a conjugate disclosed herein.

TABLE 2

Antisense Compounds Targeted to AR SEQ ID NO: 1

| ISIS No | Target Start Site | Sequence | Motif | SEQ ID NO |
|---------|---------|-----------|-------|-----------|
| 560131 | 58721 58751 | TTGATTTAATGGTTGC | kkkddddddddddkkke | 17 |
| 569213 | 58720 58750 | TGATTTAATGGTTGCA | kkkddddddddddkkke | 18 |
| 569216 | 58720 58750 | TGATTTAATGGTTGCA | ekkkddddddddddkkke | 18 |
| 569221 | 58720 58750 | TGATTTAATGGTTGCA | eekkkddddddddddkkk | 18 |
| 569236 | 58720 58750 | TGATTTAATGGTTGCA | ekkkddddddddkkkee | 18 |
| 579671 | 58721 58751 | TTGATTTAATGGTTGC | ekkekkddddddddkkk | 17 |
| 586124 | 58719 | GATTTAATGGTTGCAA | kkkddddddddddkkk | 19 |
| 583918 | 5052 | AGTCGCGACTCTGGTA | kkkddddddddddkkk | 20 |
| 584149 | 8638 | GTCAATATCAAAGCAC | kkkddddddddddkkk | 21 |
| 584163 | 11197 | GAACATTATTAGGCTA | kkkddddddddddkkk | 22 |
| 584269 | 40615 | CCTTATGGATGCTGCT | kkkddddddddddkkk | 23 |
| 584468 | 115272 | CATTGTACTATGCCAG | kkkddddddddddkkk | 24 |

AR Therapeutic Indications

In certain embodiments, the invention provides methods for using a conjugated antisense compound targeted to an AR nucleic acid for modulating the expression of AR in a subject. In certain embodiments, the expression of AR is reduced.

In certain embodiments, the invention provides methods for using a conjugated antisense compound targeted to an AR nucleic acid in a pharmaceutical composition for treating a subject. In certain embodiments, the subject has prostate cancer, such as castration-resistant prostate cancer. In certain embodiments, the subject has prostate cancer resistant to a diarylhydantoin Androgen Receptor (AR) inhibitor, such as MDV3100, which is also known as Enzalutamide. MDV3100 or Enzalutamide is an experimental androgen receptor antagonist drug developed by Medivation for the treatment of castration-resistant prostate cancer. In certain embodiments, the subject has breast cancer. In certain aspects, the subject's breast cancer can have one or more of the following characteristics: Androgen Receptor positive, dependent on androgen for growth, Estrogen Receptor (ER) negative, independent of estrogen for growth, Progesterone Receptor (PR) negative, independent of progesterone for growth, or Her2/neu negative. In certain aspects, the breast cancer or breast cancer cell is apocrine.

In certain embodiments, the invention provides methods for using a conjugated antisense compound targeted to an AR nucleic acid in the preparation of a medicament.

2. Apolipoprotein (a) (Apo(a))

One Apo(a) protein is linked via a disulfide bond to a single ApoB protein to form a lipoprotein(a) (Lp(a)) particle. The Apo(a) protein shares a high degree of homology with plasminogen particularly within the kringle IV type 2 repetitive domain. It is thought that the kringle repeat domain in Apo(a) may be responsible for its pro-thrombotic and anti-fibrinolytic properties, potentially enhancing atherosclerotic progression. Apo(a) is transcriptionally regulated by IL-6 and in studies in rheumatoid arthritis patients treated with an IL-6 inhibitor (tocilizumab), plasma levels were reduced by 30% after 3 month treatment. Apo(a) has been shown to preferentially bind oxidized phospholipids and potentiate vascular inflammation. Further, studies suggest that the Lp(a) particle may also stimulate endothelial permeability, induce plasminogen activator inhibitor type-1 expression and activate macrophage interleukin-8 secretion. Importantly, recent genetic association studies revealed that Lp(a) was an independent risk factor for myocardial infarction, stroke, peripheral vascular disease and abdominal aortic aneurysm. Further, in the Precocious Coronary Artery Disease (PROCARDIS) study, Clarke et al. described robust and independent associations between coronary heart disease and plasma Lp(a) concentrations. Additionally, Solfrizzi et al., suggested that increased serum Lp(a) may be linked to an increased risk for Alzheimer's Disease (AD). Antisense compounds targeting Apo(a) have been previously disclosed in WO2005/000201 and U.S. 61/651,539, herein incorporated by reference in its entirety. An antisense oligonucleotide targeting Apo(a), ISIS-APOA$_{Rx}$, is currently in a Phase I clinical trial to study its safety profile.

Certain Conjugated Antisense Compounds Targeted to an Apo(a) Nucleic Acid

In certain embodiments, conjugated antisense compounds are targeted to an Apo(a) nucleic acid having the sequence of GENBANK® Accession No. NM_005577.2, incorporated herein as SEQ ID NO: 2. In certain such embodiments, a conjugated antisense compound is at least 90%, at least 95%, or 100% complementary to SEQ ID NO: 2.

In certain embodiments, a conjugated antisense compound targeted to SEQ ID NO: 2 comprises an at least 8 consecutive nucleobase sequence selected from the nucleobase sequence of any of SEQ ID NOs: 25-30. In certain embodiments, a conjugated antisense compound targeted to SEQ ID NO: 2 comprises a nucleobase sequence selected from the nucleobase sequence of any of SEQ ID NOs: 25-30. In certain embodiments, such conjugated antisense compounds comprise a conjugate comprising 1-3 GalNAc ligands. In certain embodiments, such antisense compounds comprise a conjugate disclosed herein.

TABLE 3

Antisense Compounds targeted to Apo(a) SEQ ID NO: 2

| ISIS No | Target Start Site | Sequence (5'-3') | Motif | SEQ ID NO |
|---|---|---|---|---|
| 494372 | 3901 | TGCTCCGTTGGTGCTTGTTC | eeeeeddddddddddeeeee | 25 |
| 494283 | 584 | TCTTCCTGTGACAGTGGTGG | eeeeeddddddddddeeeee | 26 |
| | 926 | | | |
| | 1610 | | | |
| | 1952 | | | |
| | 2294 | | | |
| | 3320 | | | |
| 494284 | 585 | TTCTTCCTGTGACAGTGGTG | eeeeeddddddddddeeeee | 27 |
| | 927 | | | |
| | 1611 | | | |
| | 1953 | | | |
| | 2295 | | | |
| | 3321 | | | |
| 494286 | 587 | GGTTCTTCCTGTGACAGTGG | eeeeeddddddddddeeeee | 28 |
| | 929 | | | |
| | 1613 | | | |
| | 1955 | | | |
| | 2297 | | | |
| 494301 | 628 | CGACTATGCGAGTGTGGTGT | eeeeeddddddddddeeeee | 29 |
| | 970 | | | |
| | 1312 | | | |
| | 1654 | | | |
| | 1996 | | | |
| | 2338 | | | |
| | 2680 | | | |
| | 3022 | | | |
| 494302 | 629 | CCGACTATGCGAGTGTGGTG | eeeeeddddddddddeeeee | 30 |
| | 971 | | | |
| | 1313 | | | |
| | 1655 | | | |
| | 1997 | | | |
| | 2339 | | | |
| | 2681 | | | |
| | 3023 | | | |

Apo(a) Therapeutic Indications

In certain embodiments, the invention provides methods for using a conjugated antisense compound targeted to an Apo(a) nucleic acid for modulating the expression of Apo(a) in a subject. In certain embodiments, the expression of Apo(a) is reduced.

In certain embodiments, the invention provides methods for using a conjugated antisense compound targeted to an Apo(a) nucleic acid in a pharmaceutical composition for treating a subject. In certain embodiments, the subject has a cardiovascular and/or metabolic disease, disorder or condition. In certain embodiments, the subject has hypercholesterolemia, non-familial hypercholesterolemia, familial hypercholesterolemia, heterozygous familial hypercholesterolemia, homozygous familial hypercholesterolemia, mixed dyslipidemia, atherosclerosis, a risk of developing atherosclerosis, coronary heart disease, a history of coronary heart disease, early onset coronary heart disease, one or more risk factors for coronary heart disease, type II diabetes, type II diabetes with dyslipidemia, dyslipidemia, hypertriglyceridemia, hyperlipidemia, hyperfattyacidemia, hepatic steatosis, non-alcoholic steatohepatitis, and/or non-alcoholic fatty liver disease.

In certain embodiments, the invention provides methods for using a conjugated antisense compound targeted to an Apo(a) nucleic acid in the preparation of a medicament.

3. Apolipoprotein B (ApoB)

ApoB (also known as apolipoprotein B-100; ApoB-100, apolipoprotein B-48; ApoB-48 and Ag(x) antigen), is a large glycoprotein that serves an indispensable role in the assembly and secretion of lipids and in the transport and receptor-mediated uptake and delivery of distinct classes of lipoproteins. ApoB performs a variety of activities, from the absorption and processing of dietary lipids to the regulation of circulating lipoprotein levels (Davidson and Shelness, Annu. Rev. Nutr., 2000, 20, 169-193). This latter property underlies its relevance in terms of atherosclerosis susceptibility, which is highly correlated with the ambient concentration of ApoB-containing lipoproteins (Davidson and Shelness, Annu. Rev. Nutr., 2000, 20, 169-193). ApoB-100 is the major protein component of LDL-C and contains the domain required for interaction of this lipoprotein species with the LDL receptor. Elevated levels of LDL-C are a risk factor for cardiovascular disease, including atherosclerosis. Antisense compounds targeting ApoB have been previously disclosed in WO2004/044181, herein incorporated by reference in its entirety. An antisense oligonucleotide targeting ApoB, KYNAMRO™, has been approved by the U.S. Food and Drug Administration (FDA) as an adjunct treatment to lipid-lowering medications and diet to reduce low density lipoprotein-cholesterol (LDL-C), ApoB, total cholesterol (TC), and non-high density lipoprotein-cholesterol (non HDL-C) in patients with homozygous familial hypercholesterolemia (HoFH). However, there is still a need to provide patients with additional and more potent treatment options.

Certain Conjugated Antisense Compounds Targeted to an ApoB Nucleic Acid

In certain embodiments, conjugated antisense compounds are targeted to an ApoB nucleic acid having the sequence of GENBANK® Accession No. NM_000384.1, incorporated herein as SEQ ID NO: 3. In certain such embodiments, a conjugated antisense compound is at least 90%, at least 95%, or 100% complementary to SEQ ID NO: 3.

In certain embodiments, a conjugated antisense compound targeted to SEQ ID NO: 3 comprises an at least 8 consecutive nucleobase sequence of SEQ ID NO: 31. In certain embodiments, a conjugated antisense compound targeted to SEQ ID NO: 3 comprises a nucleobase sequence of SEQ ID NO: 31. In certain embodiments, such conjugated antisense compounds comprise a conjugate comprising 1-3 GalNAc ligands. In certain embodiments, such antisense compounds comprise a conjugate disclosed herein.

TABLE 4

Antisense Compounds targeted to ApoB SEQ ID NO: 3

| ISIS No | Target Start Site | Sequence (5'-3') | Motif | SEQ ID NO |
|---|---|---|---|---|
| 301012 | 3249 | GCCTCAGTCTGCTTCGCACC | eeeeedddddddddeeeee | 31 |

ApoB Therapeutic Indications

In certain embodiments, the invention provides methods for using a conjugated antisense compound targeted to an ApoB nucleic acid for modulating the expression of ApoB in a subject. In certain embodiments, the expression of ApoB is reduced.

In certain embodiments, the invention provides methods for using a conjugated antisense compound targeted to an ApoB nucleic acid in a pharmaceutical composition for treating a subject. In certain embodiments, the subject has a cardiovascular and/or metabolic disease, disorder or condition. In certain embodiments, the subject has hypercholesterolemia, non-familial hypercholesterolemia, familial hypercholesterolemia, heterozygous familial hypercholesterolemia, homozygous familial hypercholesterolemia, mixed dyslipidemia, atherosclerosis, a risk of developing atherosclerosis, coronary heart disease, a history of coronary heart disease, early onset coronary heart disease, one or more risk factors for coronary heart disease, type II diabetes, type II diabetes with dyslipidemia, dyslipidemia, hypertriglyceridemia, hyperlipidemia, hyperfattyacidemia, hepatic steatosis, non-alcoholic steatohepatitis, and/or non-alcoholic fatty liver disease.

In certain embodiments, the invention provides methods for using a conjugated antisense compound targeted to an ApoB nucleic acid in the preparation of a medicament.

4. Apolipoprotein C-III (ApoCIII)

ApoCIII is a constituent of HDL and of triglyceride (TG)-rich lipoproteins. Elevated ApoCIII levels are associated with elevated TG levels and diseases such as cardiovascular disease, metabolic syndrome, obesity and diabetes. Elevated TG levels are associated with pancreatitis. ApoCIII slows clearance of TG-rich lipoproteins by inhibiting lipolysis through inhibition of lipoprotein lipase (LPL) and through interfering with lipoprotein binding to cell-surface glycosaminoglycan matrix. Antisense compounds targeting ApoCIII have been previously disclosed in WO2004/093783 and WO2012/149495, each herein incorporated by reference in its entirety. Currently, an antisense oligonucleotide targeting ApoCIII, ISIS-APOCIII$_{Rx}$, is in Phase II clinical trials to assess its effectiveness in the treatment of diabetes or hypertriglyceridemia. However, there is still a need to provide patients with additional and more potent treatment options.

Certain Conjugated Antisense Compounds Targeted to an ApoCIII Nucleic Acid

In certain embodiments, conjugated antisense compounds are targeted to an ApoCIII nucleic acid having the sequence of GENBANK® Accession No. NT_033899.8 truncated from nucleobases 20262640 to 20266603, incorporated herein as SEQ ID NO: 4. In certain such embodiments, a conjugated antisense compound is at least 90%, at least 95%, or 100% complementary to SEQ ID NO: 4. In certain embodiments, such conjugated antisense compounds comprise a conjugate comprising 1-3 GalNAc ligands. In certain embodiments, such antisense compounds comprise a conjugate disclosed herein.

In certain embodiments, conjugated antisense compounds are targeted to an ApoCIII nucleic acid having the sequence of GENBANK® Accession No. NM_000040.1, incorporated herein as SEQ ID NO: 5. In certain such embodiments, a conjugated antisense compound is at least 90%, at least 95%, or 100% complementary to SEQ ID NO: 5. In certain embodiments, such conjugated antisense compounds comprise a conjugate comprising 1-3 GalNAc ligands. In certain embodiments, such antisense compounds comprise a conjugate disclosed herein.

In certain embodiments, a conjugated antisense compound targeted to SEQ ID NO: 5 comprises an at least 8 consecutive nucleobase sequence of SEQ ID NO: 32. In certain embodiments, a conjugated antisense compound targeted to SEQ ID NO: 5 comprises a nucleobase sequence of SEQ ID NO: 32. In certain embodiments, such conjugated antisense compounds comprise a conjugate comprising 1-3 GalNAc ligands. In certain embodiments, such antisense compounds comprise a conjugate disclosed herein.

TABLE 5

Antisense Compounds targeted to ApoCIII SEQ ID NO: 5

| ISIS No | Target Start Site | Sequence (5'-3') | Motif | SEQ ID NO |
|---|---|---|---|---|
| 304801 | 508 | AGCTTCTTGTCCAGCTTTAT | eeeeedddddddddeeeee | 32 |
| 647535 | 508 | AGCTTCTTGTCCAGCTTTAT | eeeeedddddddddeeeeeod | 32 |
| 616468 | 508 | AGCTTCTTGTCCAGCTTTAT | eeeeedddddddddeeeee | 32 |

TABLE 5-continued

Antisense Compounds targeted to ApoCIII SEQ ID NO: 5

| ISIS No | Target Start Site | Sequence (5'-3') | Motif | SEQ ID NO |
|---|---|---|---|---|
| 647536 | 508 | AGCTTCTTGTCCAGCTTTAT | eeoeoeoeoddddddddddeoeoeeeod | 32 |

ApoCIII Therapeutic Indications

In certain embodiments, the invention provides methods for using a conjugated antisense compound targeted to an ApoCIII nucleic acid for modulating the expression of ApoCIII in a subject. In certain embodiments, the expression of ApoCIII is reduced.

In certain embodiments, the invention provides methods for using a conjugated antisense compound targeted to an ApoCIII nucleic acid in a pharmaceutical composition for treating a subject. In certain embodiments, the subject has a cardiovascular and/or metabolic disease, disorder or condition. In certain embodiments, the subject has hypertriglyceridemia, non-familial hypertriglyceridemia, familial hypertriglyceridemia, heterozygous familial hypertriglyceridemia, homozygous familial hypertriglyceridemia, mixed dyslipidemia, atherosclerosis, a risk of developing atherosclerosis, coronary heart disease, a history of coronary heart disease, early onset coronary heart disease, one or more risk factors for coronary heart disease, type II diabetes, type II diabetes with dyslipidemia, dyslipidemia, hyperlipidemia, hypercholesterolemia, hyperfattyacidemia, hepatic steatosis, non-alcoholic steatohepatitis, pancreatitis and/or non-alcoholic fatty liver disease.

In certain embodiments, the invention provides methods for using a conjugated antisense compound targeted to an ApoCIII nucleic acid in the preparation of a medicament.

5. C-Reactive Protein (CRP)

CRP (also known as PTX1) is an essential human acute-phase reactant produced in the liver in response to a variety of inflammatory cytokines. The protein, first identified in 1930, is highly conserved and considered to be an early indicator of infectious or inflammatory conditions. Plasma CRP levels increase 1,000-fold in response to infection, ischemia, trauma, burns, and inflammatory conditions. In clinical trials where patients receive lipid-lowering therapy, such as statin therapy, it has been demonstrated that patients having reductions in both LDL-C and CRP have a reduced risk of future coronary events relative to patients experiencing only reductions in LDL-C. Antisense compounds targeting CRP have been previously disclosed in WO2003/010284 and WO2005/005599, each herein incorporated by reference in its entirety. An antisense oligonucleotide targeting CRP, ISIS-CRP$_{Rx}$, is currently in Phase 2 clinical trials to study its effectiveness in treating subjects with rheumatoid arthritis and paroxysmal atrial fibrillation. However, there is still a need to provide patients with additional and more potent treatment options.

Certain Conjugated Antisense Compounds Targeted to a CRP Nucleic Acid

In certain embodiments, conjugated antisense compounds are targeted to a CRP nucleic acid having the sequence of GENBANK® Accession No. M11725.1, incorporated herein as SEQ ID NO: 6. In certain such embodiments, a conjugated antisense compound is at least 90%, at least 95%, or 100% complementary to SEQ ID NO: 6.

In certain embodiments, a conjugated antisense compound targeted to SEQ ID NO: 6 comprises an at least 8 consecutive nucleobase sequence of SEQ ID NO: 33. In certain embodiments, a conjugated antisense compound targeted to SEQ ID NO: 6 comprises a nucleobase sequence of SEQ ID NO: 33. In certain embodiments, such conjugated antisense compounds comprise a conjugate comprising 1-3 GalNAc ligands. In certain embodments, such antisense compounds comprise a conjugate disclosed herein.

TABLE 6

Antisense Compounds targeted to CRP SEQ ID NO: 6

| ISIS No | Target Start Site | Sequence (5'-3') | Motif | SEQ ID NO |
|---|---|---|---|---|
| 329993 | 1378 | AGCATAGTTAAC GAGCTCCC | eeeeeddddddddddeeeee | 33 |

CRP Therapeutic Indications

In certain embodiments, the invention provides methods for using a conjugated antisense compound targeted to a CRP nucleic acid for modulating the expression of CRP in a subject. In certain embodiments, the expression of CRP is reduced.

In certain embodiments, the invention provides methods for using a conjugated antisense compound targeted to a CRP nucleic acid in a pharmaceutical composition for treating a subject. In certain embodiments, the subject has a cardiovascular and/or metabolic disease, disorder or condition. In certain embodiments, the subject has hypercholesterolemia, non-familial hypercholesterolemia, familial hypercholesterolemia, heterozygous familial hypercholesterolemia, homozygous familial hypercholesterolemia, mixed dyslipidemia, atherosclerosis, a risk of developing atherosclerosis, coronary heart disease, a history of coronary heart disease, early onset coronary heart disease, one or more risk factors for coronary heart disease. In certain embodiments, the individual has paroxysmal atrial fibrillation, acute coronary syndrome, vascular injury, arterial occlusion, unstable angina, post peripheral vascular disease, post myocardial infarction (MI), thrombosis, deep vein thrombus, end-stage renal disease (ESRD), chronic renal failure, complement activation, congestive heart failure, or systemic vasculitis. In certain embodiments, the individual has had a stroke. In certain embodiments, the individual has undergone a procedure selected from elective stent placement, angioplasty, post percutaneous transluminal angioplasty (PTCA), cardiac transplantation, renal dialysis or cardiopulmonary bypass. In certain embodiments, the individual has an inflammatory disease. In certain such embodiments, the inflammatory disease is selected from inflammatory bowel disease, ulcerative colitis, rheumatoid arthritis, or osteoarthritis.

6. eIF4E

Overexpression of eIF4E has been reported in many human cancers and cancer-derived cell lines and also leads to oncogenic transformation of cells and invasive/metastatic phenotype in animal models. Unlike non-transformed, cultured cells, transformed cell lines express eIF4E independently of the presence of serum growth factors (Rosenwald, Cancer Lett., 1995, 98, 77-82). Excess eIF4E leads to aberrant growth and neoplastic morphology in HeLa cells and also causes tumorigenic transformation in NIH 3T3 and Rat2 fibroblasts, as judged by anchorage-independent growth, formation of transformed foci in culture and tumor formation in nude mice (De Benedetti et al., Proc. Natl. Acad. Sci. USA, 1990, 87, 8212-8216; and Lazaris-Karatzas et al., Nature, 1990, 345, 544-547).

eIF4E is found elevated in several human cancers, including but not limited to non-Hodgkin's lymphomas, colon adenomas and carcinomas and larynx, head and neck, prostate, breast and bladder cancers (Crew et al., Br. J. Cancer, 2000, 82, 161-166; Graff et al., Clin. Exp. Metastasis, 2003, 20, 265-273; Haydon et al., Cancer, 2000, 88, 2803-2810; Kerekatte et al., Int. J. Cancer, 1995, 64, 27-31; Rosenwald et al., Oncogene, 1999, 18, 2507-2517; Wang et al., Am. J. Pathol., 1999, 155, 247-255). Upregulation of eIF4E is an early event in colon carcinogenesis, and is frequently accompanied by an increase in cyclin D1 levels (Rosenwald et al., Oncogene, 1999, 18, 2507-2517). Antisense compounds targeting eIF4E have been previously disclosed in WO2005/028628, herein incorporated by reference in its entirety. An antisense oligonucleotide targeting eIF4E, ISIS-eIF4E, is currently in Phase 1/2 clinical trials to study its effectiveness in treating subjects with cancer.

Certain Conjugated Antisense Compounds Targeted to an eIF4E Nucleic Acid

In certain embodiments, conjugated antisense compounds are targeted to an eIF4E nucleic acid having the sequence of GENBANK® Accession No. M15353.1, incorporated herein as SEQ ID NO: 7. In certain such embodiments, a conjugated antisense compound is at least 90%, at least 95%, or 100% complementary to SEQ ID NO: 7.

In certain embodiments, a conjugated antisense compound targeted to SEQ ID NO: 7 comprises an at least 8 consecutive nucleobase sequence of SEQ ID NO: 34. In certain embodiments, a conjugated antisense compound targeted to SEQ ID NO: 7 comprises a nucleobase sequence of SEQ ID NO: 34. In certain embodiments, such conjugated antisense compounds comprise a conjugate comprising 1-3 GalNAc ligands. In certain embodiments, such antisense compounds comprise a conjugate disclosed herein.

TABLE 7

Antisense Compounds targeted to eIF4E SEQ ID NO: 7

| ISIS No | Target Start Site | Sequence (5'-3') | Motif | SEQ ID NO |
|---|---|---|---|---|
| 183750 | 1285 | TGTCATATTCCT GGATCCTT | eeeeedddddddddd eeeee | 34 | eIF4E Therapeutic Indications

In certain embodiments, the invention provides methods for using a conjugated antisense compound targeted to an eIF4E nucleic acid for modulating the expression of eIF4E in a subject. In certain embodiments, the expression of eIF4E is reduced.

In certain embodiments, the invention provides methods for using a conjugated antisense compound targeted to an eIF4E nucleic acid in a pharmaceutical composition for treating a subject. In certain embodiments, the subject has cancer. In certain aspects, the cancer is prostate cancer.

In certain embodiments, the invention provides methods for using a conjugated antisense compound targeted to an eIF4E nucleic acid in the preparation of a medicament.

7. Factor VII

Coagulation Factor VII (also known as serum prothrombin conversion accelerator) is a key component of the tissue factor coagulation pathway. Clinicians have linked elevated levels of Factor VII activity with poor prognosis in several thrombotic diseases, such as heart attacks, and with cancer-associated thrombosis, which is the second leading cause of death in cancer patients. In preclinical studies, antisense inhibition of Factor VII rapidly reduced Factor VII activity by more than 90 percent in three days with no observed increase in bleeding, which is a common side effect of currently available anti-thrombotic drugs. Antisense compounds targeting Factor VII have been previously disclosed in WO2009/061851, WO2012/174154, and PCT Application no. PCT/US2013/025381, each herein incorporated by reference in its entirety. Clinical studies are planned to assess ISIS-FVII$_{Rx}$ in acute clinical settings, such as following surgery, to prevent patients from developing harmful blood clots. However, there is still a need to provide patients with additional and more potent treatment options.

Certain Conjugated Antisense Compounds Targeted to a Factor VII Nucleic Acid

In certain embodiments, conjugated antisense compounds are targeted to a Factor VII nucleic acid having the sequence of GENBANK® Accession No. NT_027140.6 truncated from nucleobases 1255000 to 1273000), incorporated herein as SEQ ID NO: 8. In certain such embodiments, a conjugated antisense compound targeted to SEQ ID NO: 8 is at least 90%, at least 95% or 100% complementary to SEQ ID NO: 8.

In certain embodiments, a conjugated antisense compound targeted to SEQ ID NO: 8 comprises an at least 8 consecutive nucleobase sequence of SEQ ID NOs: 35-43. In certain embodiments, a conjugated antisense compound targeted to SEQ ID NO: 8 comprises a nucleobase sequence of SEQ ID NOs: 35-43. In certain embodiments, such conjugated antisense compounds comprise a conjugate comprising 1-3 GalNAc ligands. In certain embodiments, such antisense compounds comprise a conjugate disclosed herein.

TABLE 8

Antisense Compounds targeted to Factor VII SEQ ID NO: 8

| ISIS No | Target Start Site | Sequence (5'-3') | Motif | SEQ ID NO |
|---|---|---|---|---|
| 540175 | 2592 | GGACACCCACGCCCCC | eekddddddddddkke | 35 |
|  | 2626 |  |  |  |
|  | 2660 |  |  |  |
|  | 2796 |  |  |  |
|  | 2966 |  |  |  |
|  | 3000 |  |  |  |
|  | 3034 |  |  |  |
|  | 3068 |  |  |  |
|  | 3153 |  |  |  |
|  | 3170 |  |  |  |
|  | 3272 |  |  |  |
|  | 3374 |  |  |  |
|  | 3578 |  |  |  |
|  | 3851 |  |  |  |
|  | 3953 |  |  |  |
|  | 4124 |  |  |  |
|  | 4260 |  |  |  |
|  | 4311 |  |  |  |
|  | 4447 |  |  |  |
|  | 4532 |  |  |  |
| 490279 | 1387 | CCCTCCTGTGCCTGGATGCT | eeeeeddddddddddeeeee | 36 |
| 473589 | 15128 | GCTAAACAACCGCCTT | kdkdkddddddddee | 37 |
| 407935 | 15191 | ATGCATGGTGATGCTTCTGA | eeeeeddddddddddeeeee | 38 |
| 529804 | 15192 | CATGGTGATGCTTCTG | kddddddddddkekee | 39 |
| 534796 | 15131 | AGAGCTAAACAACCGC | Ekkddddddddddkke | 40 |
| 540162 | 2565 | ACTCCCGGGACACCCA | eekddddddddddkke | 41 |
|  | 2633 |  |  |  |
|  | 2667 |  |  |  |
|  | 2735 |  |  |  |
|  | 2803 |  |  |  |
|  | 2837 |  |  |  |
|  | 2905 |  |  |  |
|  | 3007 |  |  |  |
|  | 3041 |  |  |  |
|  | 3075 |  |  |  |
|  | 3092 |  |  |  |
|  | 3279 |  |  |  |
|  | 3381 |  |  |  |
|  | 3483 |  |  |  |
|  | 3603 |  |  |  |
|  | 3722 |  |  |  |
|  | 3756 |  |  |  |
|  | 3858 |  |  |  |
|  | 3892 |  |  |  |
|  | 3960 |  |  |  |
|  | 4046 |  |  |  |
|  | 4131 |  |  |  |
|  | 4165 |  |  |  |
|  | 4318 |  |  |  |
|  | 4454 |  |  |  |
| 540182 | 2692 | ACACCCTCGCCTCCGG | eekddddddddddkke | 42 |
|  | 2760 |  |  |  |
|  | 2862 |  |  |  |
|  | 2930 |  |  |  |
|  | 3117 |  |  |  |
|  | 3338 |  |  |  |
|  | 3440 |  |  |  |
|  | 3508 |  |  |  |
|  | 3542 |  |  |  |
|  | 3628 |  |  |  |
|  | 3662 |  |  |  |
|  | 3781 |  |  |  |
|  | 3815 |  |  |  |
|  | 3917 |  |  |  |
|  | 4190 |  |  |  |
|  | 4224 |  |  |  |
|  | 4377 |  |  |  |
|  | 4411 |  |  |  |

TABLE 8-continued

Antisense Compounds targeted to Factor VII SEQ ID NO: 8

| ISIS No | Target Start Site | Sequence (5'-3') | Motif | SEQ ID NO |
|---|---|---|---|---|
| 540191 | 3109 | GCCTCCGGAACACCCA | eekddddddddddkke | 43 |
|  | 3194 |  |  |  |
|  | 3330 |  |  |  |
|  | 3432 |  |  |  |
|  | 3500 |  |  |  |
|  | 3534 |  |  |  |
|  | 3620 |  |  |  |
|  | 3654 |  |  |  |
|  | 3773 |  |  |  |
|  | 4182 |  |  |  |
|  | 4216 |  |  |  |
|  | 4369 |  |  |  |
|  | 4403 |  |  |  |

Factor VII Therapeutic Indications

In certain embodiments, the invention provides methods for using a conjugated antisense compound targeted to a Factor VII nucleic acid for modulating the expression of Factor VII in a subject. In certain embodiments, the expression of Factor VII is reduced.

In certain embodiments, the invention provides methods for using a conjugated antisense compound targeted to a Factor VII nucleic acid in a pharmaceutical composition for treating a subject. In certain embodiments, the subject has or is at risk of developing a thromboembolic condition, such as, heart attack, stroke, deep vein thrombosis, or pulmonary embolism. In certain embodiments, the subject is at risk of developing a thromboemoblic condition and/or otherwise in need of anticoagulant therapy. Examples of such subjects include those undergoing major orthopedic surgery and patients in need of chronic anticoagulant treatment. In certain embodiments, the subject has or is at risk of developing an inflammatory disease, disorder or condition. In certain embodiments, the subject has or is at risk of developing allergic diseases (e.g., allergic rhinitis, chronic rhinosinusitis), autimmune diseases (e.g, multiple sclerosis, arthritis, scleroderma, psoriasis, celiac disease), cardiovascular diseases, colitis, diabetes (e.g., type 1 insulin-dependent diabetes mellitus), hypersensitivities (e.g., Type1, 2, 3 or 4 hypersensitivity), infectious diseases (e.g., viral infection, mycobacterial infection, helminth infection), posterior uveitis, airway hyperresponsiveness, asthma, atopic dermatitis, colitis, endometriosis, thyroid disease (e.g., Graves' disease) and pancreatitis.

In certain embodiments, the invention provides methods for using a conjugated antisense compound targeted to a Factor VII nucleic acid in the preparation of a medicament.

8. Factor XI

Coagulation factor XI (also known as plasma thromboplastin antecedent) is an important member of the coagulation pathway. High levels of Factor XI increase the risk of thrombosis, a process involving aberrant blood clot formation responsible for most heart attacks and strokes. Elevated levels of Factor XI also increase the risk of venous thrombosis, a common problem after surgery, particularly major orthopedic procedures, such as knee or hip replacement. People who are deficient in Factor XI have a lower incidence of thromboembolic events with minimal increase in bleeding risk. Antisense compounds targeting Factor XI have been previously disclosed in WO2010/045509 and WO2010/121074, each herein incorporated by reference in its entirety. Currently, an antisense oligonucleotide targeting Factor XI, ISIS-FXI$_{Rx}$, is in Phase 2 clinical studies to assess the effectiveness of ISIS-FXI$_{Rx}$ in reducing the number of thrombotic events in patients following total knee arthroplasty without increasing bleeding. However, there is still a need to provide patients with additional and more potent treatment options.

Certain Conjugated Antisense Compounds Targeted to a Factor XI Nucleic Acid

In certain embodiments, conjugated antisense compounds are targeted to a Factor XI nucleic acid having the sequence of GENBANK® Accession No. NM_000128.3, incorporated herein as SEQ ID NO: 9. In certain such embodiments, a conjugated antisense compound is at least 90%, at least 95%, or 100% complementary to SEQ ID NO: 9.

In certain embodiments, a conjugated antisense compound targeted to SEQ ID NO: 9 comprises an at least 8 consecutive nucleobase sequence of SEQ ID NOs: 44-48. In certain embodiments, a conjugated antisense compound targeted to SEQ ID NO: 9 comprises a nucleobase sequence of SEQ ID NOs: 44-48. In certain embodiments, such conjugated antisense compounds comprise a conjugate comprising 1-3 GalNAc ligands. In certain embodiments, such antisense compounds comprise a conjugate disclosed herein.

TABLE 9

Antisense Compounds targeted to Factor XI SEQ ID NO: 9

| ISIS No | Target Start Site | Sequence (5'-3') | Motif | SEQ ID NO |
|---|---|---|---|---|
| 416858 | 1288 | ACGGCATTGGTGCACAGTTT | eeeeddddddddddeeeee | 44 |
| 416838 | 1022 | GCAACCGGGATGATGAGTGC | eeeeeddddddddddeeeee | 45 |

TABLE 9-continued

Antisense Compounds targeted to Factor XI SEQ ID NO: 9

| ISIS No | Target Start Site | Sequence (5'-3') | Motif | SEQ ID NO |
|---|---|---|---|---|
| 416850 | 1278 | TGCACAGTTTCTGGCAGGCC | eeeeedddddddddeeeee | 46 |
| 416864 | 1296 | GGCAGCGGACGGCATTGGTG | eeeeedddddddddeeeee | 47 |
| 417002 | 1280 | GGTGCACAGTTTCTGGCAGG | eedddddddddddeeeee | 48 |

Factor XI Therapeutic Indications

In certain embodiments, the invention provides methods for using a conjugated antisense compound targeted to a Factor XI nucleic acid for modulating the expression of Factor XI in a subject. In certain embodiments, the expression of Factor XI is reduced.

In certain embodiments, the invention provides methods for using a conjugated antisense compound targeted to a Factor XI nucleic acid in a pharmaceutical composition for treating a subject. In certain embodiments, the subject has or is at risk of developing a thromboembolic condition, such as, heart attack, stroke, deep vein thrombosis, or pulmonary embolism. In certain embodiments, the subject is at risk of developing a thromboemoblic condition and/or otherwise in need of anticoagulant therapy. Examples of such subjects include those undergoing major orthopedic surgery and patients in need of chronic anticoagulant treatment. In certain embodiments, the subject has or is at risk of developing an inflammatory disease, disorder or condition. In certain embodiments, the subject has or is at risk of developing allergic diseases (e.g., allergic rhinitis, chronic rhinosinusitis), autimmune diseases (e.g, multiple sclerosis, arthritis, scleroderma, psoriasis, celiac disease), cardiovascular diseases, colitis, diabetes (e.g., type 1 insulin-dependent diabetes mellitus), hypersensitivities (e.g., Type1, 2, 3 or 4 hypersensitivity), infectious diseases (e.g., viral infection, mycobacterial infection, helminth infection), posterior uveitis, airway hyperresponsiveness, asthma, atopic dermatitis, colitis, endometriosis, thyroid disease (e.g., Graves' disease) and pancreatitis.

In certain embodiments, the invention provides methods for using a conjugated antisense compound targeted to a Factor XI nucleic acid in the preparation of a medicament.

9. Glucocorticoid Receptor (GCCR)

Complementary DNA clones encoding the human glucocorticoid receptor (also known as nuclear receptor subfamily 3, group C, member 1; NR3C1; GCCR; GCR; GRL; Glucocorticoid receptor, lymphocyte) were first isolated in 1985 (Hollenberg et al., *Nature*, 1985, 318, 635-641; Weinberger et al., *Science*, 1985, 228, 740-742). The gene is located on human chromosome $5q_{11}$-$q_{13}$ and consists of 9 exons (Encio and Detera-Wadleigh, *J Biol Chem*, 1991, 266, 7182-7188; Gehring et al., *Proc Natl Acad Sci USA*, 1985, 82, 3751-3755).

The human glucocorticoid receptor is comprised of three major domains, the N-terminal activation domain, the central DNA-binding domain and the C-terminal ligand-binding domain (Giguere et al., *Cell,* 1986, 46, 645-652). In the absence of ligand, the glucocorticoid receptor forms a large heteromeric complex with several other proteins, from which it dissociates upon ligand binding.

In the liver, glucocorticoid agonists increase hepatic glucose production by activating the glucocorticoid receptor, which subsequently leads to increased expression of the gluconeogenic enzymes phosphoenolpyruvate carboxykinase (PEPCK) and glucose-6-phosphatase. Through gluconeogenesis, glucose is formed through non-hexose precursors, such as lactate, pyruvate and alanine (Link, Curr Opin Investig Drugs, 2003, 4, 421-429).

Antisense compounds targeting GCCR have been previously disclosed in WO2007/035759, WO2005/071080, and PCT application no. PCT/US2012/061984, each herein incorporated by reference in its entirety. An antisense oligonucleotide targeting GCCR, ISIS-GCCR$_{Rx}$, recently completed a Phase I clinical study with positive results. However, there is still a need to provide patients with additional and more potent treatment options.

Certain Conjugated Antisense Compounds Targeted to a GCCR Nucleic Acid

In certain embodiments, conjugated antisense compounds are targeted to a GCCR nucleic acid having the sequence of the complement of GENBANK Accession No. NT_029289.10 truncated from nucleobases 3818000 to 3980000, incorporated herein as SEQ ID NO: 10. In certain such embodiments, a conjugated antisense compound targeted to SEQ ID NO: 10 is at least 90%, at least 95%, or 100% complementary to SEQ ID NO: 10.

In certain embodiments, a conjugated antisense compound targeted to SEQ ID NO: 10 comprises an at least 8 consecutive nucleobase sequence of SEQ ID NOs: 49-59. In certain embodiments, a conjugated antisense compound targeted to SEQ ID NO: 10 comprises a nucleobase sequence of SEQ ID NOs: 49-59. In certain embodiments, such conjugated antisense compounds comprise a conjugate comprising 1-3 GalNAc ligands. In certain embodiments, such antisense compounds comprise a conjugate disclosed herein.

TABLE 10

Antisense Compounds targeted to GCCR SEQ ID NO: 10

| ISIS No | Target Start Site | Sequence (5'-3') | Motif | SEQ ID NO |
|---|---|---|---|---|
| 426115 | 65940 | GCAGCCATGGTGATCAGGAG | eeeeedddddddddeeeee | 49 |
| 420470 | 57825 | GGTAGAAATATAGTTGTTCC | eeeeedddddddddeeeee | 50 |

TABLE 10-continued

Antisense Compounds targeted to GCCR SEQ ID NO: 10

| ISIS No | Target Start Site | Sequence (5'-3') | Motif | SEQ ID NO |
|---|---|---|---|---|
| 420476 | 59956 | TTCATGTGTCTGCATCATGT | eeeeedddddddddeeeee | 51 |
| 426130 | 63677 | GCATCCAGCGAGCACCAAAG | eeeeedddddddddeeeee | 52 |
| 426183 | 65938 | AGCCATGGTGATCAGGAGGC | eeedddddddddddddeee | 53 |
| 426261 | 65938 | AGCCATGGTGATCAGGAGGC | eeddddddddddddeeeee | 53 |
| 426262 | 65939 | CAGCCATGGTGATCAGGAGG | eeddddddddddddeeeee | 54 |
| 426168 | 76224 | GTCTGGATTACAGCATAAAC | eeeeedddddddddeeeee | 55 |
| 426246 | 76225 | GGTCTGGATTACAGCATAAA | eeedddddddddddddeee | 56 |
| 426172 | 76229 | CCTTGGTCTGGATTACAGCA | eeeeedddddddddeeeee | 57 |
| 426325 | 76229 | CCTTGGTCTGGATTACAGCA | eeddddddddddddeeeee | 58 |
| 426267 | 95513 | GTGCTTGTCCAGGATGATGC | eeddddddddddddeeeee | 59 |

GCCR Therapeutic Indications

In certain embodiments, the invention provides methods for using a conjugated antisense compound targeted to a GCCR nucleic acid for modulating the expression of GCCR in a subject. In certain embodiments, the expression of GCCR is reduced.

In certain embodiments, the invention provides methods for using a conjugated antisense compound targeted to a GCCR nucleic acid in a pharmaceutical composition for treating a subject. In certain embodiments, the subject has metabolic related diseases, including metabolic syndrome, diabetes mellitus, insulin resistance, diabetic dyslipidemia, hypertriglyceridemia, obesity and weight gain.

Diabetes mellitus is characterized by numerous physical and physiological symptoms. Any symptom known to one of skill in the art to be associated with Type 2 diabetes can be ameliorated or otherwise modulated as set forth above in the methods described above. In certain embodiments, the symptom is a physical symptom selected from the group consisting of increased glucose levels, increased weight gain, frequent urination, unusual thirst, extreme hunger, extreme fatigue, blurred vision, frequent infections, tingling or numbness at the extremities, dry and itchy skin, weight loss, slow-healing sores, and swollen gums. In certain embodiments, the symptom is a physiological symptom selected from the group consisting of increased insulin resistance, increased glucose levels, increased fat mass, decreased metabolic rate, decreased glucose clearance, decreased glucose tolerance, decreased insulin sensitivity, decreased hepatic insulin sensitivity, increased adipose tissue size and weight, increased body fat, and increased body weight.

In certain embodiments, the invention provides methods for using a conjugated antisense compound targeted to a GCCR nucleic acid in the preparation of a medicament.

10. Glucagon Receptor (GCGR)

Diabetes is a chronic metabolic disorder characterized by impaired insulin secretion and/or action. In type 2 diabetes (T2DM), insulin resistance leads to an inability of insulin to control the activity of gluconeogenic enzymes, and many subjects also exhibit inappropriate levels of circulating glucagon in the fasting and postprandial state. Glucagon is secreted from the α-cells of the pancreatic islets and regulates glucose homeostasis through modulation of hepatic glucose production (Quesada et al., J. Endocrinol. 2008. 199: 5-19). Glucagon exerts its action on target tissues via the activation of its receptor, GCGR. The glucagon receptor is a 62 kDa protein that is a member of the class B G-protein coupled family of receptors (Brubaker et al., Recept. Channels. 2002. 8: 179-88). GCGR activation leads to signal transduction by G proteins ($G_s\alpha$ and $G_q$), whereby $G_s\alpha$ activates adenylate cyclase, which causes cAMP production, resulting in an increase in levels of protein kinase A. GCGR signaling in the liver results in increased hepatic glucose production by induction of glycogenolysis and gluconeogenesis along with inhibition of glycogenesis (Jiang and Zhang. Am. J. Physiol. Endocrinol. Metab. 2003. 284: E671-E678). GCGR is also expressed in extrahepatic tissues, which includes heart, intestinal smooth muscle, kidney, brain, and adipose tissue (Hansen et al., Peptides. 1995. 16: 1163-1166).

Antisense compounds targeting GCGR have been previously disclosed in WO2004/096996, WO2004/096016, WO2007/035771, and WO2013/043817, each herein incorporated by reference in its entirety. An antisense oligonucleotide targeting GCGR, ISIS-GCGR$_{Rx}$, recently completed a Phase I clinical study with positive results. However, there is still a need to provide patients with additional and more potent treatment options.

Certain Conjugated Antisense Compounds Targeted to a GCGR Nucleic Acid

In certain embodiments, conjugated antisense compounds are targeted to a GCGR nucleic acid having the sequence of GENBANK® Accession No NW_926918.1 truncated from nucleobases 16865000 to 16885000, incorporated herein as SEQ ID NO: 11. In certain such embodiments, a conjugated antisense compound targeted to SEQ ID NO: 11 is at least 90%, at least 95%, or 100% complementary to SEQ ID NO: 11.

In certain embodiments, a conjugated antisense compound targeted to SEQ ID NO: 11 comprises an at least 8 consecutive nucleobase sequence of SEQ ID NOs: 60-67. In certain embodiments, a conjugated antisense compound targeted to SEQ ID NO: 11 comprises a nucleobase sequence of SEQ ID NOs: 60-67. In certain embodiments, such conjugated antisense compounds comprise a conjugate comprising 1-3 GalNAc ligands. In certain embodiments, such antisense compounds comprise a conjugate disclosed herein.

In certain embodiments, the invention provides methods for using a conjugated antisense compound targeted to a GCGR nucleic acid in the preparation of a medicament.

TABLE 11

Antisense Compounds targeted to GCGR SEQ ID NO: 11

| ISIS No | Target Start Site | Sequence (5'-3') | Motif | SEQ ID NO |
|---|---|---|---|---|
| 449884 | 7270 | GGTTCCCGAGGTGCCCA | eeedddddddddeee | 60 |
|  | 7295 |  |  |  |
|  | 7319 |  |  |  |
|  | 7344 |  |  |  |
|  | 7368 |  |  |  |
|  | 7392 |  |  |  |
|  | 7416 |  |  |  |
|  | 7440 |  |  |  |
| 398471 | 8133 | TCCACAGGCCACAGGTGGGC | eeeeddddddddddeeeee | 61 |
| 436140 | 15743 | CTCTTTATTGTTGGAGGACA | eeeeddddddddddeeeee | 62 |
| 448766 | 9804 | GCAAGGCTCGGTTGGGCTTC | eeeeddddddddddeeeee | 63 |
| 459014 | 10718 | GGGCAATGCAGTCCTGG | eeedddddddddeeee | 64 |
| 459032 | 7783 | GAAGGTGACACCAGCCT | eedddddddddeeee | 65 |
| 459040 | 8144 | GCTCAGCATCCACAGGC | eedddddddddeeee | 66 |
| 459157 | 7267 | GGGTTCCCGAGGTGCCCAATG | eeeeddddddddddeeeeee | 67 |
|  | 7292 |  |  |  |
|  | 7316 |  |  |  |
|  | 7341 |  |  |  |
|  | 7365 |  |  |  |
|  | 7389 |  |  |  |
|  | 7437 |  |  |  |

GCGR Therapeutic Indications

In certain embodiments, the invention provides methods for using a conjugated antisense compound targeted to a GCGR nucleic acid for modulating the expression of GCGR in a subject. In certain embodiments, the expression of GCGR is reduced.

In certain embodiments, the invention provides methods for using a conjugated antisense compound targeted to a GCGR nucleic acid in a pharmaceutical composition for treating a subject. In certain embodiments, the subject has metabolic related diseases, including metabolic syndrome, diabetes mellitus, insulin resistance, diabetic dyslipidemia, hypertriglyceridemia, obesity and weight gain.

Diabetes mellitus is characterized by numerous physical and physiological signs and/or symptoms. Any symptom known to one of skill in the art to be associated with Type 2 diabetes can be ameliorated or otherwise modulated as set forth above in the methods described above. In certain embodiments, the symptom or sign is a physical symptom or sign such as increased glucose levels, increased weight gain, frequent urination, unusual thirst, extreme hunger, extreme fatigue, blurred vision, frequent infections, tingling or numbness at the extremities, dry and itchy skin, weight loss, slow-healing sores, and swollen gums. In certain embodiments, the symptom or sign is a physiological symptom or sign selected from the group consisting of increased insulin resistance, increased glucose levels, increased fat mass, decreased metabolic rate, decreased glucose clearance, decreased glucose tolerance, decreased insulin sensitivity, decreased hepatic insulin sensitivity, increased adipose tissue size and weight, increased body fat, and increased body weight.

In certain embodiments, the invention provides methods for using a conjugated antisense compound targeted to a GCGR nucleic acid in the preparation of a medicament.

11. Hepatitis B (HBV)

Hepatitis B is a viral disease transmitted parenterally by contaminated material such as blood and blood products, contaminated needles, sexually and vertically from infected or carrier mothers to their offspring. It is estimated by the World Health Organization that more than 2 billion people have been infected worldwide, with about 4 million acute cases per year, 1 million deaths per year, and 350-400 million chronic carriers (World Health Organization: Geographic Prevalence of Hepatitis B Prevalence, 2004. http://www.who.int/vaccines-surveillance/graphics/htmls/hepb-prev.htm).

The virus, HBV, is a double-stranded hepatotropic virus which infects only humans and non-human primates. Viral replication takes place predominantly in the liver and, to a lesser extent, in the kidneys, pancreas, bone marrow and spleen (Hepatitis B virus biology. Microbiol Mol Biol Rev. 64: 2000; 51-68.). Viral and immune markers are detectable in blood and characteristic antigen-antibody patterns evolve over time. The first detectable viral marker is HBsAg, followed by hepatitis B e antigen (HBeAg) and HBV DNA. Titers may be high during the incubation period, but HBV DNA and HBeAg levels begin to fall at the onset of illness and may be undetectable at the time of peak clinical illness (Hepatitis B virus infection—natural history and clinical consequences. N Engl J Med. 350: 2004; 1118-1129). HBeAg is a viral marker detectable in blood and correlates with active viral replication, and therefore high viral load and infectivity (Hepatitis B e antigen—the dangerous end game of hepatitis B. N Engl J Med. 347: 2002; 208-210). The presence of anti-HBsAb and anti-HBcAb (IgG) indicates recovery and immunity in a previously infected individual.

Currently the recommended therapies for chronic HBV infection by the American Association for the Study of Liver Diseases (AASLD) and the European Association for the Study of the Liver (EASL) include interferon alpha (INFa), pegylated interferon alpha-2a (Peg-IFN2a), entecavir, and tenofovir. The nucleoside and nucleobase therapies, entecavir and tenofovir, are successful at reducing viral load, but the rates of HBeAg seroconversion and HBsAg loss are even lower than those obtained using IFNα therapy. Other similar therapies, including lamivudine (3TC), telbivudine (LdT), and adefovir are also used, but for nucleoside/nucleobase therapies in general, the emergence of resistance limits therapeutic efficacy.

Thus, there is a need in the art to discover and develop new anti-viral therapies. Additionally, there is a need for new anti-HBV therapies capable of increasing HBeAg and HBsAg seroconversion rates. Recent clinical research has found a correlation between seroconversion and reductions in HBeAg (Fried et al (2008) Hepatology 47:428) and reductions in HBsAg (Moucari et al (2009) Hepatology 49:1151). Reductions in antigen levels may have allowed immunological control of HBV infection because high levels of antigens are thought to induce immunological tolerance. Current nucleoside therapies for HBV are capable of dramatic reductions in serum levels of HBV but have little impact on HBeAg and HBsAg levels.

Antisense compounds targeting HBV have been previously disclosed in WO2011/047312, WO2012/145674, and WO2012/145697, each herein incorporated by reference in its entirety. Clinical studies are planned to assess the effect of antisense compounds targeting HBV in patients. However, there is still a need to provide patients with additional and more potent treatment options.

Certain Conjugated Antisense Compounds Targeted to a HBV Nucleic Acid

In certain embodiments, conjugated antisense compounds are targeted to a HBV nucleic acid having the sequence of GENBANK® Accession No. U95551.1, incorporated herein as SEQ ID NO: 12. In certain such embodiments, a conjugated antisense compound targeted to SEQ ID NO: 12 is at least 90%, at least 95%, or 100% complementary to SEQ ID NO: 12.

In certain embodiments, a conjugated antisense compound targeted to SEQ ID NO: 12 comprises an at least 8 consecutive nucleobase sequence of SEQ ID NO: 68. In certain embodiments, a conjugated antisense compound targeted to SEQ ID NO: 12 comprises a nucleobase sequence of SEQ ID NO: 68. In certain embodiments, such conjugated antisense compounds comprise a conjugate comprising 1-3 GalNAc ligands. In certain embodiments, such antisense compounds comprise a conjugate disclosed herein.

TABLE 12

Antisense Compounds targeted to HBV SEQ ID NO: 12

| ISIS No | Target Start Site | Sequence (5'-3') | Motif | SEQ ID NO |
|---|---|---|---|---|
| 505358 | 1583 | GCAGAGGTGAA GCGAAGTGC | eeeeeddddddddddeeeee | 68 |

HBV Therapeutic Indications

In certain embodiments, the invention provides methods for using a conjugated antisense compound targeted to a HBV nucleic acid for modulating the expression of HBV in a subject. In certain embodiments, the expression of HBV is reduced.

In certain embodiments, the invention provides methods for using a conjugated antisense compound targeted to a HBV nucleic acid in a pharmaceutical composition for treating a subject. In certain embodiments, the subject has a HBV-related condition. In certain embodiments, the HBV-related condition includes, but is not limited to, chronic HBV infection, inflammation, fibrosis, cirrhosis, liver cancer, serum hepatitis, jaundice, liver cancer, liver inflammation, liver fibrosis, liver cirrhosis, liver failure, diffuse hepatocellular inflammatory disease, hemophagocytic syndrome, serum hepatitis, and HBV viremia. In certain embodiments, the HBV-related condition may have which may include any or all of the following: flu-like illness, weakness, aches, headache, fever, loss of appetite, diarrhea, jaundice, nausea and vomiting, pain over the liver area of the body, clay- or grey-colored stool, itching all over, and dark-colored urine, when coupled with a positive test for presence of a hepatitis B virus, a hepatitis B viral antigen, or a positive test for the presence of an antibody specific for a hepatitis B viral antigen. In certain embodiments, the subject is at risk for an HBV-related condition. This includes subjects having one or more risk factors for developing an HBV-related condition, including sexual exposure to an individual infected with Hepatitis B virus, living in the same house as an individual with a lifelong hepatitis B virus infection, exposure to human blood infected with the hepatitis B virus, injection of illicit drugs, being a person who has hemophilia, and visiting an area where hepatitis B is common. In certain embodiments, the subject has been identified as in need of treatment for an HBV-related condition.

In certain embodiments, the invention provides methods for using a conjugated antisense compound targeted to a HBV nucleic acid in the preparation of a medicament.

12. Protein tyrosine phosphatase 1B (PTP1B)

PTP1B is a member of a family of PTPs (Barford, et al., Science 1994. 263: 1397-1404) and is a cytosolic enzyme (Neel and Tonks, Curr. Opin. Cell Biol. 1997. 9: 193-204). PTP1B is expressed ubiquitously including tissues that are key regulators of insulin metabolism such as liver, muscle and fat (Goldstein, Receptor 1993. 3: 1-15), where it is the main PTP enzyme.

PTP1B is considered to be a negative regulator of insulin signaling. PTP1B interacts with and dephosphorylates the insulin receptor, thus attenuating and potentially terminating the insulin signalling transduction (Goldstein et al., J. Biol. Chem. 2000. 275: 4383-4389). The physiological role of PTP1B in insulin signalling has been demonstrated in knockout mice models. Mice lacking the PTP1B gene were protected against insulin resistance and obesity (Elchebly et al., Science 1999. 283: 1544-1548). PTP1B-deficient mice had low adiposity, increased basal metabolic rate as well as total energy expenditure and were protected from diet-induced obesity. Insulin-stimulated glucose uptake was elevated in skeletal muscle, whereas adipose tissue was unaffected providing evidence that increased insulin sensitivity in PTP1B-deficient mice was tissue-specific (Klaman et al., Mol. Cell. Biol. 2000. 20: 5479-5489). These mice were phenotypically normal and were also resistant to diet-induced obesity, insulin resistance and had significantly lower triglyceride levels on a high-fat diet. Therefore, inhibition of PTP1B in patients suffering from Type II diabetes, metabolic syndrome, diabetic dyslipidemia, or related metabolic diseases would be beneficial.

Antisense compounds targeting PTP1B have been previously disclosed in WO2001/053528, WO2002/092772, WO2004/071407, WO2006/044531, WO2012/142458, WO2006/044531, and WO2012/142458, each herein incorporated by reference in its entirety. An antisense oligonucleotide targeting PTP1B, ISIS-PTP1B$_{Rx}$, recently completed a Phase I clinical study with positive results. However, there is still a need to provide patients with additional and more potent treatment options.

Certain Conjugated Antisense Compounds Targeted to a PTP1B Nucleic Acid

In certain embodiments, conjugated antisense compounds are targeted to a PTP1B nucleic acid having the sequence of GENBANK® Accession No. NM_002827.2, incorporated herein as SEQ ID NO: 13 or GENBANK Accession NT_011362.9 truncated from nucleobases 14178000 to 14256000, incorporated herein as SEQ ID NO: 14. In certain such embodiments, a conjugated antisense compound targeted to SEQ ID NO: 13 is at least 90%, at least 95%, or 100% complementary to SEQ ID NO: 13.

In certain embodiments, a conjugated antisense compound targeted to SEQ ID NO: 13 comprises an at least 8 consecutive nucleobase sequence of SEQ ID NOs: 69-72. In certain embodiments, a conjugated antisense compound targeted to SEQ ID NO: 13 comprises a nucleobase sequence of SEQ ID NOs: 69-72. In certain embodiments, such conjugated antisense compounds comprise a conjugate comprising 1-3 GalNAc ligands. In certain embodiments, such antisense compounds comprise a conjugate disclosed herein.

extreme fatigue, blurred vision, frequent infections, tingling or numbness at the extremities, dry and itchy skin, weight loss, slow-healing sores, and swollen gums. In certain embodiments, the symptom is a physiological symptom selected from the group consisting of increased insulin resistance, increased fat mass, decreased metabolic rate, decreased glucose clearance, decreased glucose tolerance, decreased insulin sensitivity, decreased hepatic insulin sensitivity, increased adipose tissue size and weight, increased body fat, and increased body weight.

In certain embodiments, the invention provides methods for using a conjugated antisense compound targeted to a PTP1B nucleic acid in the preparation of a medicament.

13. STAT3

The STAT (signal transducers and activators of transcription) family of proteins comprises DNA-binding proteins that play a dual role in signal transduction and activation of transcription. Presently, there are six distinct members of the STAT family (STAT1, STAT2, STAT3, STAT4, STAT5, and STAT6) and several isoforms (STAT1α, STAT1β, STAT3α and STAT3β). The activities of the STATs are modulated by various cytokines and mitogenic stimuli. Binding of a cytokine to its receptor results in the activation of Janus protein tyrosine kinases (JAKs) associated with these receptors. This phosphorylates STAT, resulting in translocation to the nucleus and transcriptional activation of STAT responsive genes. Phosphorylation on a specific tyrosine residue on the STATs results in their activation, resulting in the formation of homodimers and/or heterodimers of STAT which bind to specific gene promoter sequences. Events mediated

TABLE 13

Conjugated Antisense Compounds targeted to PTP1B SEQ ID NO: 13

| ISIS No | Target Start Site on mRNA | Sequence (5'-3') | Chemistry | SEQ ID NO |
|---|---|---|---|---|
| 404173 | 3290 | AATGGTTTATTCCATGGCCA | eeeeedddddddddeeeee | 69 |
| 409826 | 3287 | GGTTTATTCCATGGCCATTG | eeeeedddddddddeeeee | 70 |
| 142082 | 3291 | AAATGGTTTATTCCATGGCC | eeeeedddddddddeeeee | 71 |
| 446431 | 3292 | AATGGTTTATTCCATGGC | eeeedddddddddeeee | 72 |

PTP1B Therapeutic Indications

In certain embodiments, the invention provides methods for using a conjugated antisense compound targeted to a PTP1B nucleic acid for modulating the expression of PTP1B in a subject. In certain embodiments, the expression of PTP1B is reduced.

In certain embodiments, the invention provides methods for using a conjugated antisense compound targeted to a PTP1B nucleic acid in a pharmaceutical composition for treating a subject. In certain embodiments, the subject has metabolic related diseases, including metabolic syndrome, diabetes mellitus, insulin resistance, diabetic dyslipidemia, hypertriglyceridemia, obesity and weight gain.

Diabetes mellitus is characterized by numerous physical and physiological symptoms. Any symptom known to one of skill in the art to be associated with Type 2 diabetes can be ameliorated or otherwise modulated as set forth above in the methods described above. In certain embodiments, the symptom is a physical symptom selected from the group consisting of increased glucose levels, increased weight gain, frequent urination, unusual thirst, extreme hunger, by cytokines through STAT activation include cell proliferation and differentiation and prevention of apoptosis.

The specificity of STAT activation is due to specific cytokines, i.e., each STAT is responsive to a small number of specific cytokines. Other non-cytokine signaling molecules, such as growth factors, have also been found to activate STATs. Binding of these factors to a cell surface receptor associated with protein tyrosine kinase also results in phosphorylation of STAT.

STAT3 (also acute phase response factor (APRF)), in particular, has been found to be responsive to interleukin-6 (IL-6) as well as epidermal growth factor (EGF) (Darnell, Jr., J. E., et al., Science, 1994, 264, 1415-1421). In addition, STAT3 has been found to have an important role in signal transduction by interferons (Yang, C.-H., et al., Proc. Natl. Acad. Sci. USA, 1998, 95, 5568-5572). Evidence exists suggesting that STAT3 may be regulated by the MAPK pathway. ERK2 induces serine phosphorylation and also associates with STAT3 (Jain, N., et al., Oncogene, 1998, 17, 3157-3167).

STAT3 is expressed in most cell types (Zhong, Z., et al., Proc. Natl. Acad. Sci. USA, 1994, 91, 4806-4810). It induces the expression of genes involved in response to tissue injury and inflammation. STAT3 has also been shown to prevent apoptosis through the expression of bcl-2 (Fukada, T., et al., Immunity, 1996, 5, 449-460).

Recently, STAT3 was detected in the mitochondria of transformed cells, and was shown to facilitate glycolytic and oxidative phosphorylation activities similar to that of cancer cells (Gough, D. J., et al., Science, 2009, 324, 1713-1716). The inhibition of STAT3 in the mitochondria impaired malignant transformation by activated Ras. The data confirms a Ras-mediated transformation function for STAT3 in the mitochondria in addition to its nuclear roles.

Aberrant expression of or constitutive expression of STAT3 is associated with a number of disease processes.

Antisense compounds targeting STAT3 have been previously disclosed in WO2012/135736 and WO2005/083124, each herein incorporated by reference in its entirety. An antisense oligonucleotide targeting STAT3, ISIS-STAT3, is currently in Phase 1/2 clinical trials to study its effectiveness in treating subjects with cancer. However, there is still a need to provide patients with additional and more potent treatment options.

Certain Conjugated Antisense Compounds Targeted to a STAT3 Nucleic Acid

In certain embodiments, conjugated antisense compounds are targeted to a STAT3 nucleic acid having the sequence of GENBANK® Accession No. NM_139276.2, incorporated herein as SEQ ID NO: 15. In certain such embodiments, a conjugated antisense compound targeted to SEQ ID NO: 15 is at least 90%, at least 95%, or 100% complementary to SEQ ID NO: 15.

In certain embodiments, a conjugated antisense compound targeted to SEQ ID NO: 15 comprises an at least 8 consecutive nucleobase sequence of SEQ ID NO: 73. In certain embodiments, a conjugated antisense compound targeted to SEQ ID NO: 15 comprises a nucleobase sequence of SEQ ID NO: 73. In certain embodiments, such conjugated antisense compounds comprise a conjugate comprising 1-3 GalNAc ligands. In certain embodiments, such antisense compounds comprise a conjugate disclosed herein.

TABLE 14

Antisense Compounds targeted to STAT3 SEQ ID NO: 15

| ISIS No | Target Start Site | Sequence (5'-3') | Motif | SEQ ID NO |
|---|---|---|---|---|
| 481464 | 3016 | CTATTTGGA TGTCAGC | kkkddddddddddkkk | 73 |

STAT3 Therapeutic Indications

In certain embodiments, the invention provides methods for using a conjugated antisense compound targeted to a STAT3 nucleic acid for modulating the expression of STAT3 in a subject. In certain embodiments, the expression of STAT3 is reduced.

In certain embodiments, the invention provides methods for using a conjugated antisense compound targeted to a STAT3 nucleic acid in a pharmaceutical composition for treating a subject. In certain embodiments, the subject has a hyperproliferative disease, disorder or condition. In certain embodiments such hyperproliferative disease, disorder, and condition include cancer as well as associated malignancies and metastases. In certain embodiments, such cancers include lung cancer, including non small cell lung cancer (NSCLC), pancreatic cancer, colorectal cancer, multiple myeloma, hepatocellular carcinoma (HCC), glioblastoma, ovarian cancer, osteosarcoma, head and neck cancer, breast cancer, epidermoid carcinomas, intestinal adenomas, prostate cancer, and gastric cancer.

In certain embodiments, the invention provides methods for using a conjugated antisense compound targeted to a STAT3 nucleic acid in the preparation of a medicament.

14. Transthyretin (TTR) TTR (also known as prealbumin, hyperthytoxinemia, dysprealbuminemic, thyroxine; senile systemic amyloidosis, amyloid polyneuropathy, amyloidosis I, PALB; dystransthyretinemic, HST2651; TBPA; dysprealbuminemic euthyroidal hyperthytoxinemia) is a serum/plasma and cerebrospinal fluid protein responsible for the transport of thyroxine and retinol (Sakaki et al, Mol Biol Med. 1989, 6:161-8). Structurally, TTR is a homotetramer; point mutations and misfolding of the protein leads to deposition of amyloid fibrils and is associated with disorders, such as senile systemic amyloidosis (SSA), familial amyloid polyneuropathy (FAP), and familial amyloid cardiopathy (FAC).

TTR is synthesized primarily by the liver and the choroid plexus of the brain and, to a lesser degree, by the retina in humans (Palha, Clin Chem Lab Med, 2002, 40, 1292-1300). Transthyretin that is synthesized in the liver is secreted into the blood, whereas transthyretin originating in the choroid plexus is destined for the CSF. In the choroid plexus, transthyretin synthesis represents about 20% of total local protein synthesis and as much as 25% of the total CSF protein (Dickson et al., J Biol Chem, 1986, 261, 3475-3478).

With the availability of genetic and immunohistochemical diagnostic tests, patients with TTR amyloidosis have been found in many nations worldwide. Recent studies indicate that TTR amyloidosis is not a rare endemic disease as previously thought, and may affect as much as 25% of the elderly population (Tanskanen et al, Ann Med. 2008; 40(3): 232-9).

At the biochemical level, TTR was identified as the major protein component in the amyloid deposits of FAP patients (Costa et al, Proc. Natl. Acad. Sci. USA 1978, 75:4499-4503) and later, a substitution of methionine for valine at position 30 of the protein was found to be the most common molecular defect causing the disease (Saraiva et al, J. Clin. Invest. 1984, 74: 104-119). In FAP, widespread systemic extracellular deposition of TTR aggregates and amyloid fibrils occurs throughout the connective tissue, particularly in the peripheral nervous system (Sousa and Saraiva, Prog. Neurobiol. 2003, 71: 385-400). Following TTR deposition, axonal degeneration occurs, starting in the unmyelinated and myelinated fibers of low diameter, and ultimately leading to neuronal loss at ganglionic sites.

Antisense compounds targeting TTR have been previously disclosed in US2005/0244869, WO2010/017509, and WO2011/139917, each herein incorporated by reference in its entirety. An antisense oligonucleotide targeting TTR, ISIS-TTR, is currently in Phase 2/3 clinical trials to study its effectiveness in treating subjects with Familial Amyloid Polyneuropathy. However, there is still a need to provide patients with additional and more potent treatment options.

Certain Conjugated Antisense Compounds Targeted to a TTR Nucleic Acid

In certain embodiments, conjugated antisense compounds are targeted to a TTR nucleic acid having the sequence of GENBANK® Accession No. NM_000371.3, incorporated herein as SEQ ID NO: 16. In certain such embodiments, a conjugated antisense compound targeted to SEQ ID NO: 16 is at least 90%, at least 95%, or 100% complementary to SEQ ID NO: 16.

In certain embodiments, a conjugated antisense compound targeted to SEQ ID NO: 16 comprises an at least 8 consecutive nucleobase sequence of SEQ ID NOs: 74-81. In certain embodiments, a conjugated antisense compound targeted to SEQ ID NO: 16 comprises a nucleobase sequence of SEQ ID NO: 74-81. In certain embodiments, such conjugated antisense compounds comprise a conjugate comprising 1-3 GalNAc ligands. In certain embodiments, such antisense compounds comprise a conjugate disclosed herein.

TABLE 15

Antisense Compounds targeted to TTR SEQ ID NO: 16

| ISIS No | Target Start Site | Sequence (5'-3') | Motif | SEQ ID NO |
|---------|-------------------|------------------|-------|-----------|
| 420915 | 508 | TCTTGGTTACATGAAATCCC | eeeeedddddddddeeeee | 74 |
| 304299 | 507 | CTTGGTTACATGAAATCCCA | eeeeedddddddddeeeee | 75 |
| 420921 | 515 | GGAATACTCTTGGTTACATG | eeeeedddddddddeeeee | 76 |
| 420922 | 516 | TGGAATACTCTTGGTTACAT | eeeeedddddddddeeeee | 77 |
| 420950 | 580 | TTTTATTGTCTCTGCCTGGA | eeeeedddddddddeeeee | 78 |
| 420955 | 585 | GAATGTTTTATTGTCTCTGC | eeeeedddddddddeeeee | 79 |
| 420957 | 587 | AGGAATGTTTTATTGTCTCT | eeeeedddddddddeeeee | 80 |
| 420959 | 589 | ACAGGAATGTTTTATTGTCT | eeeeedddddddddeeeee | 81 |

TTR Therapeutic Indications

In certain embodiments, the invention provides methods for using a conjugated antisense compound targeted to a TTR nucleic acid for modulating the expression of TTR in a subject. In certain embodiments, the expression of TTR is reduced.

In certain embodiments, the invention provides methods for using a conjugated antisense compound targeted to a TTR nucleic acid in a pharmaceutical composition for treating a subject. In certain embodiments, the subject has a transthyretin related disease, disorder or condition, or symptom thereof. In certain embodiments, the transthyretin related disease, disorder or condition is transthyretin amyloidosis. "Transthyretin-related amyloidosis" or "transthyretin amyloidosis" or "Transthyretin amyloid disease", as used herein, is any pathology or disease associated with dysfunction or dysregulation of transthyretin that result in formation of transthyretin-containing amyloid fibrils. Transthyretin amyloidosis includes, but is not limited to, hereditary TTR amyloidosis, leptomeningeal amyloidosis, familial amyloid polyneuropathy (FAP), familial amyloid cardiomyopathy, familial oculoleptomeningeal amyloidosis, senile cardiac amyloidosis, or senile systemic amyloidosis.

In certain embodiments, the invention provides methods for using a conjugated antisense compound targeted to a TTR nucleic acid in the preparation of a medicament.

15. PCSK9

PCSK9 (also known as Proprotein convertase subtilisin kexin 9) is a member of the subtilisin serine protease family. The other eight mammalian subtilisin proteases, PCSK1-PCSK8 (also called PC1/3, PC2, furin, PC4, PC5/6, PACE4, PC7, and S1P/SKI-1) are proprotein convertases that process a wide variety of proteins in the secretory pathway and play roles in diverse biological processes (Bergeron, F. (2000) J. Mol. Endocrinol. 24, 1-22, Gensberg, K., (1998) Semin. Cell Dev. Biol. 9, 11-17, Seidah, N. G. (1999) Brain Res. 848, 45-62, Taylor, N. A., (2003) FASEB J. 17, 1215-1227, and Zhou, A., (1999) J. Biol. Chem. 274, 20745-20748). PCSK9 has been proposed to play a role in cholesterol metabolism. PCSK9 mRNA expression is down-regulated by dietary cholesterol feeding in mice (Maxwell, K. N., (2003) J. Lipid Res. 44, 2109-2119), up-regulated by statins in HepG2 cells (Dubuc, G., (2004) Arterioscler. Thromb. Vasc. Biol. 24, 1454-1459), and up-regulated in sterol regulatory element binding protein (SREBP) transgenic mice (Horton, J. D., (2003) Proc. Natl. Acad. Sci. USA 100, 12027-12032), similar to the cholesterol biosynthetic enzymes and the low-density lipoprotein receptor (LDLR).

Furthermore, PCSK9 missense mutations have been found to be associated with a form of autosomal dominant hypercholesterolemia (Hchola3) (Abifadel, M., et al. (2003) Nat. Genet. 34, 154-156, Timms, K. M., (2004) Hum. Genet. 114, 349-353, Leren, T. P. (2004) Clin. Genet. 65, 419-422). PCSK9 may also play a role in determining LDL cholesterol levels in the general population, because single-nucleotide polymorphisms (SNPs) have been associated with cholesterol levels in a Japanese population (Shioji, K., (2004) J. Hum. Genet. 49, 109-114).

Antisense compounds targeting PCSK9 have been previously disclosed in U.S. Pat. Nos. 8,084,437; 8,093,222; 8,664,190; and International applications WO 2008/066776 and WO 2009/148605. However, there is still a need to provide patients with additional and more potent treatment options.

Certain Conjugated Antisense Compounds Targeted to a PCSK9 Nucleic Acid

In certain embodiments, conjugated antisense compounds are targeted to a PCSK9 nucleic acid having the sequence of GENBANK® Accession NM_174936.3, incorporated herein as SEQ ID NO: 82. In certain such embodiments, a conjugated antisense compound targeted to SEQ ID NO: 82 is at least 90%, at least 95%, or 100% complementary to SEQ ID NO: 82.

In certain embodiments, a conjugated antisense compound targeted to SEQ ID NO: 82 comprises an at least 8 consecutive nucleobase sequence of SEQ ID NOs: 83-86. In certain embodiments, a conjugated antisense compound targeted to SEQ ID NO: 82 comprises a nucleobase sequence of SEQ ID NO: 83-86. In certain embodiments, such conjugated antisense compounds comprise a conjugate comprising 1-3 GalNAc ligands. In certain embodiments, such antisense compounds comprise a conjugate disclosed herein.

TABLE 16

Antisense Compounds targeted to PCSK9 SEQ ID NO: 156

| ISIS No | Target Start Site | Sequence (5'-3') | Motif | SEQ ID NO |
|---|---|---|---|---|
| 405879 | 1073 | CCTTGGCCACGCCGGCATCC | eeeeedddddddddeeeee | 83 |
| 431131 | 1015 | GTCACACTTGCTGGCCTGTC | eeeeedddddddddeeeee | 84 |
| 405995 | 2001 | TGGCAGTGGACACGGGTCCC | eeeeedddddddddeeeee | 85 |
| 480604 | 3381 | ACTCACCGAGCTTCCTGGTC | eeeeedddddddddeeeee | 86 |

PCSK9 Therapeutic Indications

In certain embodiments, the invention provides methods for using a conjugated antisense compound targeted to a PCSK9 nucleic acid for modulating the expression of PCSK9 in a subject. In certain embodiments, the expression of PCSK9 is reduced.

In certain embodiments, the invention provides methods for using a conjugated antisense compound targeted to a PCSK9 nucleic acid in a pharmaceutical composition for treating a subject. In certain embodiments, the subject has a PCSK9 related disease, disorder or condition, or symptom thereof. In certain embodiments, the PCSK9 related disease, disorder or condition is a metabolic or cardiovascular disease.

In certain embodiments, the invention provides methods for using a conjugated antisense compound targeted to a PCSK9 nucleic acid in the preparation of a medicament.

16. Complement Factor B

The complement system is part of the host innate immune system involved in lysing foreign cells, enhancing phagocytosis of antigens, clumping antigen-bearing agents, and attracting macrophages and neutrophils. The complement system is divided into three initiation pathways—the classical, lectin, and alternative pathways—that converge at component C3 to generate an enzyme complex known as C3 convertase, which cleaves C3 into C3a and C3b. C3b associates with C3 convertase mediated by CFB and results in generation of C5 convertase, which cleaves C5 into C5a and C5b, which initiates the membrane attack pathway resulting in the formation of the membrane attack complex (MAC) comprising components C5b, C6, C7, C8, and C9. The membrane-attack complex (MAC) forms transmembrane channels and disrupts the phospholipid bilayer of target cells, leading to cell lysis.

In the homeostatic state, the alternative pathway is continuously activated at a low "tickover" level as a result of activation of the alternative pathway by spontaneous hydrolysis of C3 and the production of C3b, which generates C5 convertase.

TABLE 17

Oligonucleotide targeted to human Complement Factor B (CFB)

| Isis No. | Sequence (5' to 3') | SEQ ID No. |
|---|---|---|
| 588540 | $A_{es}T_{es}{}^mC_{es}{}^mC_{es}{}^mC_{es}A_{ds}{}^mC_{ds}G_{ds}{}^mC_{ds}{}^mC_{ds}$ ${}^mC_{ds}{}^mC_{ds}T_{ds}G_{ds}T_{ds}{}^mC_{es}{}^mC_{es}A_{es}G_{es}{}^mC_e$ | 87 |

17. Angiopoietin-Like 3

Diabetes and obesity (sometimes collectively referred to as "diabesity") are interrelated in that obesity is known to exacerbate the pathology of diabetes and greater than 60% of diabetics are obese. Most human obesity is associated with insulin resistance and leptin resistance. In fact, it has been suggested that obesity may have an even greater impact on insulin action than diabetes itself (Sindelka et al., *Physiol Res.*, 2002, 51, 85-91). Additionally, several compounds on the market for the treatment of diabetes are known to induce weight gain, a very undesirable side effect to the treatment of this disease.

Cardiovascular disease is also interrelated to obesity and diabetes. Cardiovascular disease encompasses a wide variety of etiologies and has an equally wide variety of causative agents and interrelated players. Many causative agents contribute to symptoms such as elevated plasma levels of cholesterol, including non-high density lipoprotein cholesterol (non-HDL-C), as well as other lipid-related disorders. Such lipid-related disorders, generally referred to as dyslipidemia, include hyperlipidemia, hypercholesterolemia and hypertriglyceridemia among other indications. Elevated non-HDL cholesterol is associated with atherogenesis and its sequelae, including cardiovascular diseases such as arteriosclerosis, coronary artery disease, myocardial infarction, ischemic stroke, and other forms of heart disease. These rank as the most prevalent types of illnesses in industrialized countries. Indeed, an estimated 12 million people in the United States suffer with coronary artery disease and about 36 million require treatment for elevated cholesterol levels.

Epidemiological and experimental evidence has shown that high levels of circulating triglyceride (TG) can contribute to cardiovascular disease and a myriad of metabolic disorders (Valdivielso et al., 2009, *Atherosclerosis* Zhang et al., 2008, *Circ Res.* 1; 102(2):250-6). TG derived from either exogenous or endogenous sources is incorporated and secreted in chylomicrons from the intestine or in very low density lipoproteins (VLDL) from the liver. Once in circulation, TG is hydrolyzed by lipoprotein lipase (LpL) and the resulting free fatty acids can then be taken up by local tissues and used as an energy source. Due to the profound effect LpL has on plasma TG and metabolism in general, discovering and developing compounds that affect LpL activity are of great interest.

Metabolic syndrome is a combination of medical disorders that increase one's risk for cardiovascular disease and diabetes. The symptoms, including high blood pressure, high triglycerides, decreased HDL and obesity, tend to appear together in some individuals. It affects a large number of people in a clustered fashion. In some studies, the prevalence in the USA is calculated as being up to 25% of the population. Metabolic syndrome is known under various other names, such as (metabolic) syndrome X, insulin resistance syndrome, Reaven's syndrome or CHAOS. With the high prevalence of cardiovascular disorders and metabolic disorders there remains a need for improved approaches to treat these conditions The angiopoietins are a family of secreted growth factors. Together with their respective endothelium-specific receptors, the angiopoietins play important roles in angiogenesis. One family member, angiopoietin-like 3 (also known as angiopoietin-like protein 3, ANGPT5, ANGPTL3, or angiopoietin 5), is predominantly expressed in the liver, and is thought to play a role in regulating lipid metabolism (Kaplan et al., *J. Lipid Res.*, 2003, 44, 136-143). Genome-wide association scans (GWAS) surveying the genome for common variants associated with plasma concentrations of HDL, LDL and triglyceride found an association between triglycerides and single-nucleotide polymorphisms (SNPs) near ANGPTL3 (Willer et al., Nature Genetics, 2008, 40(2): 161-169). Individuals with homozygous ANGPTL3 loss-of-function mutations present with low levels of all atherogenic plasma lipids and lipoproteins, such as total cholesterol (TC) and TG, low density lipoprotein cholesterol (LDL-C), apolipoprotein B (apoB), non-HDL-C, as well as HDL-C (Romeo et al. 2009, *J Clin Invest*, 119(1):70-79; Musunuru et al. 2010 *N Engl J Med*, 363:2220-2227; Martin-Campos et al. 2012, *Clin Chim Acta*, 413:552-555; Minicocci et al. 2012, *J Clin Endocrinol Metab*, 97:e1266-1275; Noto et al. 2012, *Arterioscler Thromb Vasc Biol*, 32:805-809; Pisciotta et al. 2012, *Circulation Cardiovasc Genet*, 5:42-50). This clinical phenotype has been termed familial combined hypolipidemia (FHBL2). Despite reduced secretion of VLDL, subjects with FHBL2 do not have increased hepatic fat content. They also appear to have lower plasma glucose and insulin levels, and importantly, both diabetes and cardiovascular disease appear to be absent from these subjects. No adverse clinical phenotypes have been reported to date (Minicocci et al. 2013, *J of Lipid Research*, 54:3481-3490). Reduction of ANGPTL3 has been shown to lead to a decrease in TG, cholesterol and LDL levels in animal models (U.S. Ser. No. 13/520,997; PCT Publication WO 2011/085271). Mice deficient in ANGPTL3 have very low plasma triglyceride (TG) and cholesterol levels, while overpexpression produces the opposite effects (Koishi et al. 2002; Koster 2005; Fujimoto 2006). Accordingly, the potential role of ANGPTL3 in lipid metabolism makes it an attractive target for therapeutic intervention.

The oligonucleotides in Table 18 below were designed to target human angiopoietin-like 3 (ANGPTL3).

TABLE 18

Oligonucleotide designed to target human angiopoietin-like 3

| ISIS No. | Sequence (5' to 3') | SEQ ID No. |
|---|---|---|
| 563580 | $G_{es}G_{es}A_{es}{}^mC_{es}A_{es}T_{ds}T_{ds}G_{ds}{}^mC_{ds}{}^mC_{ds}A_{ds}G_{ds}T_{ds}A_{ds}A_{ds}T_{es}{}^mC_{es}G_{es}{}^mC_{es}A_{e}$ | 88 |

18. Plasma Prekallikrein (PKK)

Plasma prekallikrein (PKK) is the precursor of plasma kallikrein (PK), which is encoded by the KLKB1 gene. PKK is a glycoprotein that participates in the surface-dependent activation of blood coagulation, fibrinolysis, kinin generation, and inflammation. PKK is converted to PK by Factor XIIa by the cleavage of an internal Arg-Ile peptide bond. PK liberates kinins from kininogens and also generates plasmin from plasminogen. PK is a member of the kinin-kallikrein pathway, which consists of several proteins that play a role in inflammation, blood pressure control, coagulation, and pain.

TABLE 19

Oligonucleotide targeted to human Plasma prekallikrein (PKK)

| Isis No. | Sequence (5' to 3') | SEQ ID No. |
|---|---|---|
| 546254 | $T_{es}G_{es}{}^mC_{es}A_{es}A_{es}G_{ds}T_{ds}{}^mC_{ds}T_{ds}{}^mC_{ds}T_{ds}T_{ds}G_{ds}G_{ds}{}^mC_{ds}A_{es}A_{es}A_{es}{}^mC_{es}A_{e}$ | 89 |

19. GHR

Growth hormone is produced in the pituitary and secreted into the bloodstream where it binds to growth hormone receptor (GHR) on many cell types, causing production of insulin-like growth factor-1 (IGF-1). IGF-1 is produced mainly in the liver, but also in adipose tissue and the kidney, and secreted into the bloodstream. Several disorders, such as acromegaly and gigantism, are associated with elevated growth hormone levels and/or elevated IGF-I levels in plasma and/or tissues.

Excessive production of growth hormone can lead to diseases such as acromegaly or gigantism. Acromegaly and gigantism are associated with excess growth hormone, often caused by a pituitary tumor, and affects 40-50 per million people worldwide with about 15,000 patients in each of the US and Europe and an annual incidence of about 4-5 per million people. Acromegaly and gigantism are initially characterized by abnormal growth of the hands and feet and bony changes in the facial features. Many of the growth related outcomes are mediated by elevated levels of serum IGF-1.

Embodiments provided herein relate to methods, compounds, and compositions for treating, preventing, or ameliorating a disease associated with excess growth hormone. Several embodiments provided herein are drawn to antisense compounds or oligonucleotides targeted to growth hormone receptor (GHR). Several embodiments are directed to treatment, prevention, or amelioration of acromegaly with antisense compounds or oligonucleotides targeted to growth hormone receptor (GHR).

TABLE 20

Oligonucleotides designed to target growth hormone receptor (GHR)

| Isis No. | Sequence (5' to 3') | SEQ ID No. |
|---|---|---|
| 532254 | $A_{es}G_{es}{}^mC_{es}A_{es}T_{es}A_{ds}G_{ds}A_{ds}T_{ds}T_{ds}T_{ds}T_{ds}G_{ds}A_{ds}{}^mC_{ds}T_{es}T_{es}{}^mC_{es}{}^mC_{es}{}^mC_{e}$ | 90 |
| 532401 | ${}^mC_{es}{}^mC_{es}A_{es}{}^mC_{es}{}^mC_{es}T_{ds}T_{ds}T_{ds}G_{ds}G_{ds}G_{ds}T_{ds}G_{ds}A_{ds}A_{ds}T_{es}A_{es}G_{es}{}^mC_{es}A_{e}$ | 91 |

TABLE 20-continued

Oligonucleotides designed to target growth hormone receptor (GHR)

| Isis No. | Sequence (5' to 3') | SEQ ID No. |
|---|---|---|
| 523723 | $A_{es}{}^mC_{es}T_{es}{}^mC_{es}A_{es}A_{ds}{}^mC_{ds}T_{ds}T_{ds}G_{ds}A_{ds}G_{ds}G_{ds}A_{ds}{}^mC_{ds}A_{es}A_{es}T_{es}A_{es}A_{e}$ | 92 |
| 541767 | $A_{es}G_{es}{}^mC_{ks}T_{ds}G_{ds}A_{ds}A_{ds}A_{ds}G_{ds}G_{ds}{}^mC_{ds}A_{ds}A_{ds}{}^mC_{ds}{}^mC_{ks}A_{ks}G_{e}$ | 93 |
| 541875 | $A_{es}G_{es}A_{ks}G_{ds}T_{ds}T_{ds}G_{ds}A_{ds}{}^mC_{ds}A_{ds}T_{ds}G_{ds}G_{ds}G_{ks}{}^mC_{ks}A_{e}$ | 94 |
| 542112 | ${}^mC_{es}{}^mC_{es}A_{ks}G_{ds}T_{ds}A_{ds}G_{ds}T_{ds}{}^mC_{ds}A_{ds}A_{ds}T_{ds}A_{ds}T_{ks}T_{ks}A_{e}$ | 95 |
| 542118 | ${}^mC_{es}T_{es}{}^mC_{ks}A_{ds}A_{ds}{}^mC_{ds}T_{ds}T_{ds}G_{ds}A_{ds}G_{ds}G_{ds}A_{ds}{}^mC_{ks}A_{ks}A_{e}$ | 96 |
| 542185 | $A_{es}G_{es}T_{ks}A_{ds}T_{ds}A_{ds}T_{ds}T_{ds}{}^mC_{ds}A_{ds}G_{ds}T_{ds}{}^mC_{ds}{}^mC_{ks}A_{ks}A_{e}$ | 97 |

E. Certain Nucleic Acid GalNAc Conjugates

In certain embodiments, conjugated antisense compounds comprise antisense compounds having the nucleobase sequence of the antisense compounds in Table 21 below attached to a GalNAc conjugate. In certain embodiments, conjugated antisense compounds comprise antisense compounds having the nucleobase sequence and chemical modifications of the antisense compounds in Table 21 below attached to a GalNAc conjugate. All internucleoside linkages are phosphorothioate internucleoside linkages unless otherwise indicated. A subscript "l" indicates an LNA bicyclic nucleoside. A subscript "d" indicates a 2'-deoxy nucleoside. A subscript "e" indicates a 2'-MOE modified nucleoside. A subscript "v" indicates a 2-amino-2'-deoxyadenosine.

TABLE 21

| Sequence 5' to 3' | Target | Motif | Chemistry | Internucleoside Linkages | SEQ ID NO |
|---|---|---|---|---|---|
| $T_lG_lC_dA_dA_dG_dC_dA_dT_dC_dC_dT_lG_lT_lA_d$ | HIF-1α | 3-9-3-1 | LNA/deoxy | phosphorothioate | 98 |
| $C_lT_lC_lA_lA_dT_dC_dC_dA_dT_dG_lG_dC_lA_lG_lC_d$ | Survivin | 4-8-3-1 | LNA/deoxy | phosphorothioate | 99 |
| $A_lC_lC_lA_dA_dG_dT_dT_dT_dC_dT_dT_dC_dA_lG_lC_l$ | Androgen Receptor | 3-10-3 | LNA/deoxy | phosphorothioate | 100 |
| $G_lC_lA_dT_dT_dG_dG_dT_dA_dT_dT_lC_lA_l$ | ApoB | 2-8-3 | LNA/deoxy | phosphorothioate | 101 |
| $T_lT_lC_lA_lG_lC_dA_dT_dT_dG_dG_dT_dA_dT_dT_dC_lA_lG_lT_lG_l$ | ApoB | 5-10-5 | LNA/deoxy | phosphorothioate | 102 |
| $C_lA_lG_lC_dA_dT_dT_dG_dG_dT_dA_dT_dT_lC_lA_lG_d$ | ApoB | 3-10-3 | LNA/deoxy | phosphorothioate | 103 |
| $C_lA_lG_lC_dA_dT_dT_dG_dG_dT_dA_dT_dT_lC_lA_l$ | ApoB | 3-9-3 | LNA/deoxy | phosphorothioate | 104 |
| $A_lG_lC_lA_dT_dT_dG_dG_dT_dA_dT_dT_lC_lA_l$ | ApoB | 3-8-3 | LNA/deoxy | phosphorothioate | 105 |
| $G_lC_lA_dT_dT_dG_dG_dT_dA_dT_dT_lC_l$ | ApoB | 2-8-2 | LNA/deoxy | phosphorothioate | 106 |
| $T_lG_lC_lT_dA_dC_dA_dA_dA_dA_dC_dC_lC_lA_l$ | PCSK9 | 3-8-3 | LNA/deoxy | phosphorothioate | 107 |
| $C_lcC_dA_lT_dG_lT_lC_dA_dC_lA_dC_lT_dC_lC_l$ | miR-122 | | LNA/deoxy | phosphorothioate | 108 |
| CGGCATGTCTATTTTGTA | TGF-β2 | | | phosphorothioate | 109 |
| GGCTAAATCGCTCCACCAAG | RRM2 | | | phosphorothioate | 110 |
| CTCTAGCGTCTTAAAGCCGA | RRM1 | | | phosphorothioate | 111 |
| GCTGCATGATCTCCTTGGCG | AKT-1 | | | phosphorothioate | 112 |
| ACGTTGAGGGGCATCGTCGC | c-Myc | | | Morpholino | 113 |
| CGGTTAGAAGACTCATCTTT | Influenza PB1-AUG | | | Morpholino | 114 |
| CTCCAACATCAAGGAAGATGGCATTTCTAG | dystrophin | | | Morpholino | 115 |
| GAATATTAACANACTGACAAGTC | Marburg virus NP | | | Morpholino | 116 |

TABLE 21-continued

| Sequence 5' to 3' | Target | Motif | Chemistry | Internucleoside Linkages | SEQ ID NO |
|---|---|---|---|---|---|
| CGTTGATANTTCTGCCATNCT | Marburg virus VP24 | | | Morpholino | 117 |
| GCCATGGTTTTTTCTCAGG | Ebola virus VP24 | | | Morpholino | 118 |
| CCTGCCCTTTGTTCTAGTTG | Ebola virus VP35 | | | Morpholino | 119 |
| $GGGTCTGCA_vGCGGGA_vTGGT$ | CCR3 & CSF2RB | | | phosphorothioate | 120 |
| $GTTA_vCTA_vCTTCCA_vCCTGCCTG$ | CCR3 & CSF2RB | | | phosphorothioate | 121 |
| TATCCGGAGGGCTCGCCATGCTGCT | IRS-1 | | | phosphorothioate | 122 |
| GTCGCCCCTTCTCCCCGCAGC | Smad7 | | | phosphorothioate | 123 |
| GGACCCTCCTCCGGAGCC | IGF-1R | | | phosphorothioate | 124 |
| ACCAGGCGTCTCGTGGGGCACAT | Ki-67 | | | phosphorothioate | 125 |
| TCTCCCAGCGTGCGCCAT | BCL-2 | | | phosphorothioate | 126 |
| GTGCTCCATTGATGC | c-Raf | | | phosphate | 127 |
| $T_eC_eC_eC_eG_eC_eCTGTGACAT_eG_eC_eA_eT_eT_e$ | c-Raf | 6-8-6 | MOE/deoxy | | 128 |
| $C_eA_eG_eC_eAGCAGAGTCTTCAT_eC_eA_eT_e$ | Clusterin | 4-13-4 | MOE/deoxy | | 129 |
| $G_eG_eG_eA_eC_dG_dC_dG_dG_dC_dG_dC_dT_dC_dG_dG_dT_eC_eA_eT_e$ | HSPB1 | 4-12-4 | MOE/deoxy | | 130 |
| $C_eC_eA_eC_eA_eA_dG_dC_dT_dG_dT_dC_dC_dA_dG_dT_eC_eT_eA_eA_e$ | CTGF | 5-10-5 | MOE/deoxy | | 131 |
| $C_eC_eG_eC_dA_dG_dC_dC_dA_dT_dG_dC_dG_eC_eT_eC_eT_eT_eG_eG_e$ | CD49d/ VLA-4 | 3-9-8 | MOE/deoxy | | 132 |
| $T_eC_eA_eG_eG_eG_dC_dA_dT_dT_dC_dT_dT_dT_dC_dC_eA_eT_eT_eC_e$ | GHR | 5-10-5 | MOE/deoxy | | 133 |
| $C_eG_eA_eA_eG_eG_dA_dA_dA_dC_dA_dA_dT_dA_dC_dT_eC_eC_eG_eA_e$ | IGF-1R | 5-10-5 | MOE/deoxy | | 134 |
| $G_eA_eC_eA_eG_eC_dA_dG_dC_dC_dG_dC_dA_dG_dC_dA_eG_eA_eA_eA_e$ | hepcidin | 5-10-5 | MOE/deoxy | | 135 |
| $T_eG_eG_eA_eA_eA_dG_dG_dC_dT_dT_dA_dT_dA_dC_dC_eC_eC_eT_eC_e$ | IL-4Rα1 | 5-10-5 | MOE/deoxy | | 136 |
| TCAAGGAAGATGGCATTTCT | dystrophin | | 2'-O-Methyl | phosphorothioate | 137 |
| GUGGCUAACAGAAGCU | dystrophin | | 2'-O-Methyl | phosphorothioate | 138 |
| UUUGCCGCUGCCCAAUGCCAUCCUG | dystrophin | | 2'-O-Methyl | phosphorothioate | 139 |
| $G_mC_mG_mU_mG_dC_dC_dT_dC_dC_dT_dC_dA_dC_dU_mG_mG_mC_m$ | Protein kinase A | 4-10-4 | 2'-O-Methyl/deoxy | phosphorothioate | 140 |

Additional Sequences and Oligonucleotides Suitable for Conjugateion with any Conjugate Herein In certain embodiments, a compound comprises an antisense oligonucleotide targeted to eukaryotic Initiation Factor 4E (eIF4E) known in the art and a conjugate group described herein. In certain embodiments, antisense oligonucleotides targeted to dIF4E are RNAi (siRNA or ssRNA) compounds. In certain embodiments, antisense oligonucleotides targeted to dIF4E are RNase H based antisense compounds. Examples of antisense oligonucleotides targeted to eIF4E suitable for conjugation include but are not limited to those disclosed in U.S. Pat. No. 7,425,544, which is incorporated by reference in its entirety herein. In certain embodiments, a compound comprises an antisense oligonucleotide having a nucleobase sequence of any of SEQ ID NOs: 18-122 disclosed in U.S. Pat. No. 7,425,544 and a conjugate group described herein. In certain embodiments, a compound comprises an antisense strand having a nucleobase sequence of any of SEQ ID NOs: 212-459 disclosed in U.S. Pat. No. 7,425,544 and a conjugate group described herein. The nucleobase sequences of all of the aforementioned referenced SEQ ID NOs are incorporated by reference herein.

In certain embodiments, a compound comprises an antisense oligonucleotide targeted to Signal Transducer and Activator of Transcription 3 (STAT3) known in the art and a conjugate group described herein. In certain embodiments, antisense oligonucleotides targeted to STAT3 are RNAi (siRNA or ssRNA) compounds. In certain embodiments, antisense oligonucleotides targeted to STAT3 are RNase H based antisense compounds. Examples of antisense oligonucleotides targeted to STAT3 suitable for conjugation include but are not limited to those disclosed in WO 2012/135736, WO 2005/083124, and U.S. Pat. No. 6,727,064; which are incorporated by reference in their entireties herein. In certain embodiments, a compound comprises an antisense oligonucleotide having a nucleobase sequence of any of SEQ ID NOs: 9-426, 430-442, 445-464, 471-498, 500-1034, 1036-1512, and 1541-2757 disclosed in WO 2012/135736 and a conjugate group described herein. In certain embodiments, a compound comprises an antisense oligonucleotide having a nucleobase sequence of any of SEQ ID NOs: 2-81, 108-150, and 159-381 disclosed in WO 2005/083124 and a conjugate group described herein. In certain embodiments, a compound comprises an antisense oligonucleotide having a nucleobase sequence of any of SEQ ID NOs: 2-81 and 108-150 disclosed in U.S. Pat. No. 6,727,064 and a conjugate group described herein. The nucleobase sequences of all of the aforementioned referenced SEQ ID NOs are incorporated by reference herein.

In certain embodiments, a compound comprises an antisense oligonucleotide targeted to glucocorticoid receptor (GCCR) known in the art and a conjugate group described herein. In certain embodiments, antisense oligonucleotides targeted to GCCR are RNAi (siRNA or ssRNA) compounds. In certain embodiments, antisense oligonucleotides targeted to GCCR are RNase H based antisense compounds. Examples of antisense oligonucleotides targeted to GCCR suitable for conjugation include but are not limited to those disclosed in WO 2005/071080, WO 2007/035759, and WO 2007/136988; which are incorporated by reference in their entireties herein. In certain embodiments, a compound comprises an antisense oligonucleotide having a nucleobase sequence of any of SEQ ID NOs: 30-216, and 306-310 disclosed in WO 2005/071080 and a conjugate group described herein. In certain embodiments, a compound comprises an antisense oligonucleotide having a nucleobase sequence of any of SEQ ID NOs: 26-113 disclosed in WO 2007/035759 and a conjugate group disclosed herein. In certain embodiments, a compound comprises an antisense oligonucleotide having a nucleobase sequence of any of SEQ ID NOs: 413-485 disclosed in WO 2007/136988 and a conjugate group disclosed herein. The nucleobase sequences of all of the aforementioned referenced SEQ ID NOs are incorporated by reference herein.

In certain embodiments, a compound comprises an antisense oligonucleotide targeted to glucagon receptor (GCGR) known in the art and a conjugate group described herein. In certain embodiments, antisense oligonucleotides targeted to GCGR are RNAi (siRNA or ssRNA) compounds. In certain embodiments, antisense oligonucleotides targeted to GCGR are RNase H based antisense compounds. Examples of antisense oligonucleotides targeted to GCGR suitable for conjugation include but are not limited to those disclosed in U.S. Pat. Nos. 7,750,142; 7,399,853; WO 2007/035771; and WO 2007/134014; which are incorporated by reference in their entireties herein. In certain embodiments, a compound comprises an antisense oligonucleotide having a nucleobase sequence of any of SEQ ID NOs: 20-399 disclosed in U.S. Pat. No. 7,750,142 and a conjugate group described herein. In certain embodiments, a compound comprises an antisense oligonucleotide having a nucleobase sequence of any of SEQ ID NOs: 20-399 disclosed in U.S. Pat. No. 7,399,853 and a conjugate group described herein. In certain embodiments, a compound comprises an antisense oligonucleotide having a nucleobase sequence of SEQ ID NO: 2 disclosed in WO 2007/035771 and a conjugate group described herein. In certain embodiments, a compound comprises an antisense oligonucleotide having a nucleobase sequence of any of SEQ ID NOs: 486-680 disclosed in WO 2007/134014 and a conjugate group described herein. The nucleobase sequences of all of the aforementioned referenced SEQ ID NOs are incorporated by reference herein.

In certain embodiments, a compound comprises an antisense oligonucleotide targeted to Protein Tyrosine Phosphatase 1B (PTP1B) known in the art and a conjugate group described herein. In certain embodiments, antisense oligonucleotides targeted to PTP1B are RNAi (siRNA or ssRNA) compounds. In certain embodiments, antisense oligonucleotides targeted to PT1B are RNase H based antisense compounds. Examples of antisense oligonucleotides targeted to PTP1B suitable for conjugation include but are not limited to those disclosed in U.S. Pat. No. 7,563,884 and WO 2007/131237, which are incorporated by reference in their entireties herein. In certain embodiments, a compound comprises an antisense oligonucleotide having a nucleobase sequence of any of SEQ ID NOs 17-96 and 244-389 disclosed in U.S. Pat. No. 7,563,884 and a conjugate group described herein. In certain embodiments, a compound comprises an antisense oligonucleotide having a nucleobase sequence of any of SEQ ID NOs 886-1552 disclosed in WO 2007/131237 and a conjugate group described herein. The nucleobase sequences of all of the aforementioned referenced SEQ ID NOs are incorporated by reference herein.

In certain embodiments, a compound comprises an antisense oligonucleotide targeted to Fibroblast Growth Factor Receptor 4 (FGFR4) known in the art and a conjugate group described herein. In certain embodiments, antisense oligonucleotides targeted to FGFR4 are RNAi (siRNA or ssRNA) compounds. In certain embodiments, antisense oligonucleotides targeted to FGFR4 are RNase H based antisense compounds. Examples of antisense oligonucleotides targeted to FGFR4 suitable for conjugation include but are not limited to those disclosed in WO 2009/046141, which is incorporated by reference in its entirety herein. In certain embodiments, a compound comprises an antisense oligonucleotide having a nucleobase sequence of any of SEQ ID NOs 21-24, 28, 29, 36, 38, 39, 43, 48, 51, 54-56, 58-60, 64-66, and 92-166 disclosed in WO 2009/046141 and a conjugate group described herein. The nucleobase sequences of all of the aforementioned referenced SEQ ID NOs are incorporated by reference herein.

In certain embodiments, a compound comprises an antisense oligonucleotide targeted to alpha-1-antitrypsin (A1AT) known in the art and a conjugate group described herein. In certain embodiments, antisense oligonucleotides targeted to A1AT are RNAi (siRNA or ssRNA) compounds. In certain embodiments, antisense oligonucleotides targeted to A1AT are RNase H based antisense compounds. Examples of antisense oligonucleotides targeted to A1AT suitable for conjugation include but are not limited to those disclosed in WO 2013/142514, which is incorporated by reference in its entirety herein. In certain embodiments, a compound comprises an antisense oligonucleotide having a nucleobase sequence of any of SEQ ID NOs 20-41 disclosed in WO 2013/142514 and a conjugate group described herein. The nucleobase sequences of all of the aforementioned referenced SEQ ID NOs are incorporated by reference herein.

In certain embodiments, a compound comprises an antisense oligonucleotide targeted to Factor VII known in the art and a conjugate group described herein. In certain embodiments, antisense oligonucleotides targeted to Factor VII are RNAi (siRNA or ssRNA) compounds. In certain embodiments, antisense oligonucleotides targeted to Factor VII are RNase H based antisense compounds. Examples of antisense oligonucleotides targeted to Factor VII suitable for conjugation include but are not limited to those disclosed in WO 2013/119979 and WO 2009/061851, which are incorporated by reference in their entireties herein. In certain embodiments, a compound comprises an antisense oligonucleotide having a nucleobase sequence of any of SEQ ID NOs 21-659 disclosed in WO 2013/119979 and a conjugate group described herein. In certain embodiments, a compound comprises an antisense oligonucleotide having a nucleobase sequence of any of SEQ ID NOs 4-159 and 168-611 disclosed in WO 2009/061851 and a conjugate group described herein. The nucleobase sequences of all of the aforementioned referenced SEQ ID NOs are incorporated by reference herein.

In certain embodiments, a compound comprises an antisense oligonucleotide targeted to Factor XI known in the art and a conjugate group described herein. In certain embodiments, antisense oligonucleotides targeted to Factor XI are RNAi (siRNA or ssRNA) compounds. In certain embodiments, antisense oligonucleotides targeted to Factor XI are RNase H based antisense compounds. Examples of antisense oligonucleotides targeted to Factor XI suitable for conjugation include but are not limited to those disclosed in WO 2010/045509 and WO 2010/121074, which are incorporated by reference in their entireties herein. In certain embodiments, a compound comprises an antisense oligonucleotide having a nucleobase sequence of any of SEQ ID NOs 15-270 disclosed in WO 2010/045509 and a conjugate group described herein. In certain embodiments, a compound comprises an antisense oligonucleotide having a nucleobase sequence of any of SEQ ID NOs 15-270 disclosed in WO 2010/121074 and a conjugate group described herein. The nucleobase sequences of all of the aforementioned referenced SEQ ID NOs are incorporated by reference herein.

In certain embodiments, a compound comprises an antisense oligonucleotide targeted to Hepatitis B Virus (HBV) known in the art and a conjugate group described herein. In certain embodiments, antisense oligonucleotides targeted to HBV are RNAi (siRNA or ssRNA) compounds. In certain embodiments, antisense oligonucleotides targeted to HBV are RNase H based antisense compounds. Examples of antisense oligonucleotides targeted to HBV suitable for conjugation include but are not limited to those disclosed in WO 2012/145697 and WO 2012/145697, which are incorporated by reference in their entireties herein. In certain embodiments, a compound comprises an antisense oligonucleotide having a nucleobase sequence of any of SEQ ID NOs 5-310, 321-802, 804-1272, 1288-1350, 1364-1372, 1375, 1376, and 1379 disclosed in WO 2012/145697 and a conjugate group described herein. In certain embodiments, a compound comprises an antisense oligonucleotide having a nucleobase sequence of any of SEQ ID NOs 14-22 disclosed in WO 2011/047312 and a conjugate group described herein. The nucleobase sequences of all of the aforementioned referenced SEQ ID NOs are incorporated by reference herein.

In certain embodiments, a compound comprises an antisense oligonucleotide targeted to transthyretin (TTR) known in the art and a conjugate group described herein. In certain embodiments, antisense oligonucleotides targeted to TTR are RNAi (siRNA or ssRNA) compounds. In certain embodiments, antisense oligonucleotides targeted to TTR are RNase H based antisense compounds. Examples of antisense oligonucleotides targeted to TTR suitable for conjugation include but are not limited to those disclosed in WO 2011/139917 and U.S. Pat. No. 8,101,743, which are incorporated by reference in their entireties herein. In certain embodiments, a compound comprises an antisense oligonucleotide having a nucleobase sequence of any of SEQ ID NOs 8-160, 170-177 disclosed in WO 2011/139917 and a conjugate group described herein. In certain embodiments, a compound comprises an antisense oligonucleotide having a nucleobase sequence of any of SEQ ID NOs 12-89 disclosed in U.S. Pat. No. 8,101,743 and a conjugate group described herein. In certain embodiments, a compound comprises an antisense oligonucleotide having a nucleobase sequence complementary to a preferred target segment of any of SEQ ID NOs 90-133 disclosed in U.S. Pat. No. 8,101,743 and a conjugate group described herein. The nucleobase sequences of all of the aforementioned referenced SEQ ID NOs are incorporated by reference herein.

In certain embodiments, a compound comprises an antisense oligonucleotide targeted to apolipoprotein(a) (apo(a)) known in the art and a conjugate group described herein. In certain embodiments, antisense oligonucleotides targeted to apo(a) are RNAi (siRNA or ssRNA) compounds. In certain embodiments, antisense oligonucleotides targeted to apo(a) are RNase H based antisense compounds. Examples of antisense oligonucleotides targeted to apo(a) suitable for conjugation include but are not limited to those disclosed in WO 2013/177468; U.S. Pat. Nos. 8,673,632; 7,259,150; and US Patent Application Publication No. US 2004/0242516; which are incorporated by reference in their entireties herein. In certain embodiments, a compound comprises an antisense oligonucleotide having a nucleobase sequence of any of SEQ ID NOs 12-130, 133, 134 disclosed in WO 2013/177468 and a conjugate group described herein. In certain embodiments, a compound comprises an antisense oligonucleotide having a nucleobase sequence of any of SEQ ID NOs 11-45 and 85-96 disclosed in U.S. Pat. No. 8,673,632 and a conjugate group described herein. In certain embodiments, a compound comprises an antisense oligonucleotide having a nucleobase sequence of any of SEQ ID NOs 11-45 disclosed in U.S. Pat. No. 7,259,150 and a conjugate group described herein. In certain embodiments, a compound comprises an antisense oligonucleotide having a nucleobase sequence of any of SEQ ID NOs 7-41 disclosed in US Patent Application Publication No. US 2004/0242516 and a conjugate group described herein. The nucleobase sequences of all of the aforementioned referenced SEQ ID NOs are incorporated by reference herein.

In certain embodiments, a compound comprises an antisense oligonucleotide targeted to Apolipoprotein B (ApoB) known in the art and a conjugate group described herein. In certain embodiments, antisense oligonucleotides targeted to ApoB are RNAi (siRNA or ssRNA) compounds. In certain embodiments, antisense oligonucleotides targeted to ApoB are RNase H based antisense compounds. Examples of antisense oligonucleotides targeted to ApoB suitable for conjugation include but are not limited to those disclosed in US Patent Application Publication Nos. US 2010/0331390, US 2009/0306180, and US 2005/0009088; which are incorporated by reference in their entireties herein. In certain embodiments, a compound comprises an antisense oligonucleotide having a nucleobase sequence of SEQ ID NO: 20 disclosed in US 2010/0331390 and a conjugate group described herein. In certain embodiments, a compound comprises an antisense oligonucleotide having a nucleobase sequence of any of SEQ ID NOs 16-213 disclosed in US 2009/0306180 and a conjugate group described herein. In certain embodiments, a compound comprises an antisense oligonucleotide having a nucleobase sequence of any of SEQ ID NOs 17-70, 124-317, 319-333, 335-502, 504-804, and 864-887 disclosed in US 2005/0009088 and a conjugate group described herein. The nucleobase sequences of all of the aforementioned referenced SEQ ID NOs are incorporated by reference herein.

In certain embodiments, a compound comprises an antisense oligonucleotide targeted to Apolipoprotein C-III (ApoC-III) known in the art and a conjugate group described herein. In certain embodiments, antisense oligonucleotides targeted to ApoC-III are RNAi (siRNA or ssRNA) compounds. In certain embodiments, antisense oligonucleotides targeted to ApoC-III are RNase H based antisense compounds. Examples of antisense oligonucleotides targeted to ApoC-III suitable for conjugation include but are not limited to those disclosed in US Patent Application Publication No. US 2013/0317085, which is incorporated by reference in its entirety herein. In certain embodiments, a compound comprises an antisense oligonucleotide having a nucleobase sequence of any of SEQ ID NOs 19-96 and 209-221 disclosed in US 2013/0317085 and a conjugate group described herein. The nucleobase sequences of all of the aforementioned referenced SEQ ID NOs are incorporated by reference herein.

In certain embodiments, a compound comprises an antisense oligonucleotide targeted to proprotein convertase subtilisin/kexin type 9 (PCSK9) known in the art and a conjugate group described herein. In certain embodiments, antisense oligonucleotides targeted to PCSK9 are RNAi (siRNA or ssRNA) compounds. In certain embodiments, antisense oligonucleotides targeted to PCSK9 are RNase H based antisense compounds. Examples of antisense oligonucleotides targeted to PCSK9 suitable for conjugation include but are not limited to those disclosed in U.S. Pat. Nos. 8,143,230 and 8,664,190; which are incorporated by reference in their entireties herein. In certain embodiments, a compound comprises an antisense oligonucleotide having a nucleobase sequence of any of SEQ ID NOs 329-403 disclosed in U.S. Pat. No. 8,143,230 and a conjugate group described herein. In certain embodiments, a compound comprises an antisense oligonucleotide having a nucleobase sequence of any of SEQ ID NOs 4-455 and 458-461 disclosed in U.S. Pat. No. 8,664,190 and a conjugate group described herein. The nucleobase sequences of all of the aforementioned referenced SEQ ID NOs are incorporated by reference herein.

In certain embodiments, a compound comprises an antisense oligonucleotide targeted to C-reactive protein (CRP) known in the art and a conjugate group described herein. In certain embodiments, antisense oligonucleotides targeted to CRP are RNAi (siRNA or ssRNA) compounds. In certain embodiments, antisense oligonucleotides targeted to CRP are RNase H based antisense compounds. Examples of antisense oligonucleotides targeted to CRP suitable for conjugation include but are not limited to those disclosed in WO 2003/010284, WO 2005/005599, and WO 2007/143317; which are incorporated by reference in their entireties herein. In certain embodiments, a compound comprises an antisense oligonucleotide having a nucleobase sequence of any of SEQ ID NOs 10-63 disclosed in WO 2003/010284 and a conjugate group described herein. In certain embodiments, a compound comprises an antisense oligonucleotide having a nucleobase sequence of any of SEQ ID NOs 19-72, 76-259, and 598-613 disclosed in WO 2005/005599 and a conjugate group described herein. In certain embodiments, a compound comprises an antisense oligonucleotide having a nucleobase sequence of any of SEQ ID NOs 409-412 disclosed in WO 2007/143317 and a conjugate group described herein. The nucleobase sequences of all of the aforementioned referenced SEQ ID NOs are incorporated by reference herein.

F. Certain Pharmaceutical Compositions

In certain embodiments, the present disclosure provides pharmaceutical compositions comprising one or more antisense compound. In certain embodiments, such pharmaceutical composition comprises a suitable pharmaceutically acceptable diluent or carrier. In certain embodiments, a pharmaceutical composition comprises a sterile saline solution and one or more antisense compound. In certain embodiments, such pharmaceutical composition consists of a sterile saline solution and one or more antisense compound. In certain embodiments, the sterile saline is pharmaceutical grade saline. In certain embodiments, a pharmaceutical composition comprises one or more antisense compound and sterile water. In certain embodiments, a pharmaceutical composition consists of one or more antisense compound and sterile water. In certain embodiments, the sterile saline is pharmaceutical grade water. In certain embodiments, a pharmaceutical composition comprises one or more antisense compound and phosphate-buffered saline (PBS). In certain embodiments, a pharmaceutical composition consists of one or more antisense compound and sterile phosphate-buffered saline (PBS). In certain embodiments, the sterile saline is pharmaceutical grade PBS.

In certain embodiments, antisense compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

Pharmaceutical compositions comprising antisense compounds encompass any pharmaceutically acceptable salts, esters, or salts of such esters. In certain embodiments, pharmaceutical compositions comprising antisense compounds comprise one or more oligonucleotide which, upon administration to an animal, including a human, is capable of providing (directly or indirectly) the biologically active metabolite or residue thereof. Accordingly, for example, the disclosure is also drawn to pharmaceutically acceptable salts of antisense compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of an oligonucleotide which are cleaved by endogenous nucleases within the body, to form the active antisense oligonucleotide.

Lipid moieties have been used in nucleic acid therapies in a variety of methods. In certain such methods, the nucleic acid is introduced into preformed liposomes or lipoplexes made of mixtures of cationic lipids and neutral lipids. In certain methods, DNA complexes with mono- or polycationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions provided herein comprise one or more modified oligonucleotides and one or more excipients. In certain such embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, a pharmaceutical composition provided herein comprises a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, a pharmaceutical composition provided herein comprises one or more tissue-specific delivery molecules designed to deliver the one or more pharmaceutical agents of the present disclosure to specific tissues or cell types. For example, in certain embodiments, pharmaceutical compositions include liposomes coated with a tissue-specific antibody.

In certain embodiments, a pharmaceutical composition provided herein comprises a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, a pharmaceutical composition provided herein is prepared for oral administration. In certain embodiments, pharmaceutical compositions are prepared for buccal administration.

In certain embodiments, a pharmaceutical composition is prepared for administration by injection (e.g., intravenous, subcutaneous, intramuscular, etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes. Aqueous injection suspensions may contain substances that increase the viscosity of the suspension, such as sodium carboxymethyl cellulose, sorbitol, or dextran. Optionally, such suspensions may also contain suitable stabilizers or agents that increase the solubility of the pharmaceutical agents to allow for the preparation of highly concentrated solutions.

In certain embodiments, a pharmaceutical composition is prepared for transmucosal administration. In certain of such embodiments penetrants appropriate to the barrier to be permeated are used in the formulation. Such penetrants are generally known in the art.

In certain embodiments, a pharmaceutical composition provided herein comprises an oligonucleotide in a therapeutically effective amount. In certain embodiments, the therapeutically effective amount is sufficient to prevent, alleviate or ameliorate symptoms of a disease or to prolong the survival of the subject being treated. Determination of a therapeutically effective amount is well within the capability of those skilled in the art.

In certain embodiments, one or more modified oligonucleotide provided herein is formulated as a prodrug. In certain embodiments, upon in vivo administration, a prodrug is chemically converted to the biologically, pharmaceutically or therapeutically more active form of an oligonucleotide. In certain embodiments, prodrugs are useful because they are easier to administer than the corresponding active form. For example, in certain instances, a prodrug may be more bioavailable (e.g., through oral administration) than is the corresponding active form. In certain instances, a prodrug may have improved solubility compared to the corresponding active form. In certain embodiments, prodrugs are less water soluble than the corresponding active form. In certain instances, such prodrugs possess superior transmittal across cell membranes, where water solubility is detrimental to mobility. In certain embodiments, a prodrug is an ester. In certain such embodiments, the ester is metabolically hydrolyzed to carboxylic acid upon administration. In certain instances the carboxylic acid containing compound is the corresponding active form. In certain embodiments, a prodrug comprises a short peptide (polyaminoacid) bound to an acid group. In certain of such embodiments, the peptide is cleaved upon administration to form the corresponding active form.

In certain embodiments, the present disclosure provides compositions and methods for reducing the amount or activity of a target nucleic acid in a cell. In certain embodiments, the cell is in an animal. In certain embodiments, the animal is a mammal. In certain embodiments, the animal is a rodent. In certain embodiments, the animal is a primate. In certain embodiments, the animal is a non-human primate. In certain embodiments, the animal is a human.

In certain embodiments, the present disclosure provides methods of administering a pharmaceutical composition comprising an oligonucleotide of the present disclosure to an animal. Suitable administration routes include, but are not limited to, oral, rectal, transmucosal, intestinal, enteral, topical, suppository, through inhalation, intrathecal, intracerebroventricular, intraperitoneal, intranasal, intraocular, intratumoral, and parenteral (e.g., intravenous, intramuscular, intramedullary, and subcutaneous). In certain embodiments, pharmaceutical intrathecals are administered to achieve local rather than systemic exposures. For example, pharmaceutical compositions may be injected directly in the area of desired effect (e.g., into the liver).

NONLIMITING DISCLOSURE AND INCORPORATION BY REFERENCE

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Certain compounds, compositions, and methods herein are described as "comprising exactly" or "comprises exactly" a particular number of a particular element or feature. Such descriptions are used to indicate that while the compound, composition, or method may comprise additional other elements, the number of the particular element or feature is the identified number. For example, "a conjugate comprising exactly one GalNAc" is a conjugate that contains one and only one GalNAc, though it may contain other elements in addition to the one GalNAc.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH for the natural 2'-H of DNA) or as an RNA having a modified base (thymine (methylated uracil) for natural uracil of RNA).

Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligonucleotide having the nucleobase sequence "ATCGATCG" encompasses any oligonucleotides having such nucleobase sequence, whether modified or unmodified, including, but not limited to, such compounds comprising RNA bases, such as those having sequence "AUCGAUCG" and those having some DNA bases and some RNA bases such as "AUCGAUCG" and oligonucleotides having other modified bases, such as "AT$^{me}$CGAUCG," wherein $^{me}$C indicates a cytosine base comprising a methyl group at the 5-position.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif And, for example, where a particular high-affinity modification appears at a particular position, other high-affinity modifications at the same position are considered suitable, unless otherwise indicated.

Example 1: Synthesis of Oligonucleotides Comprising a GalNAc Modified at the C6 Position

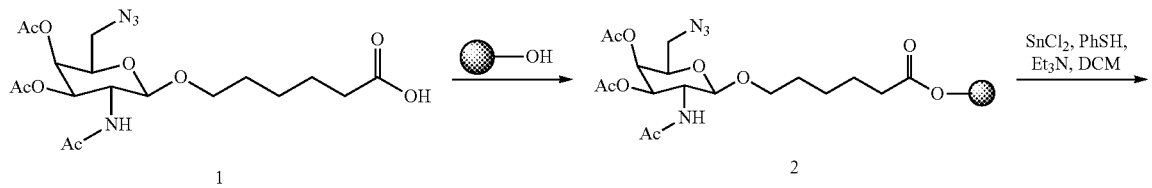

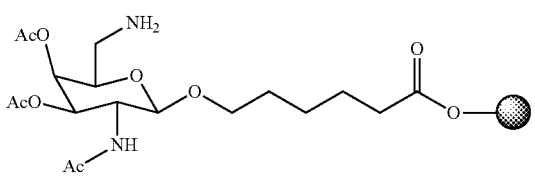

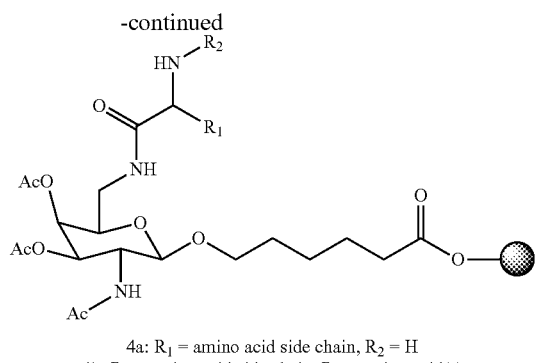

4a: R₁ = amino acid side chain, R₂ = H
4b: R₁ = amino acid side chain, R₂ = amino acid(s)

OR

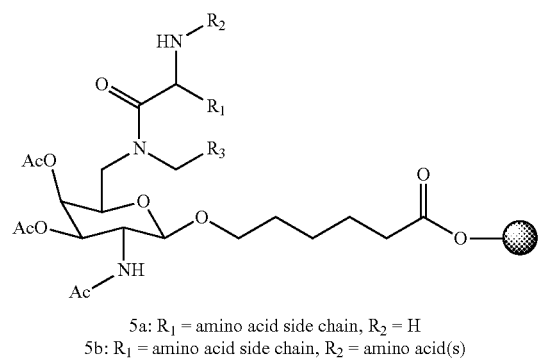

5a: R₁ = amino acid side chain, R₂ = H
5b: R₁ = amino acid side chain, R₂ = amino acid(s)

OR

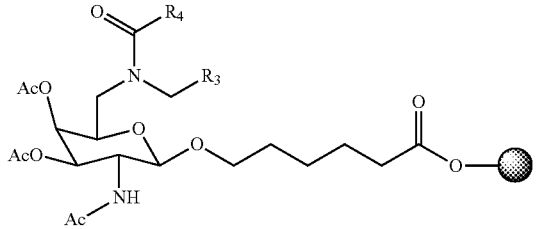

6

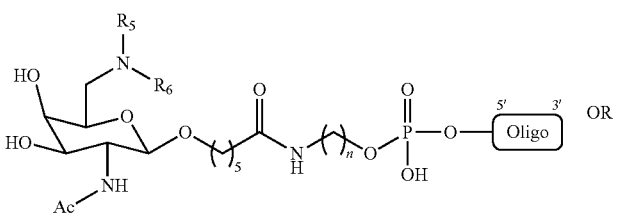

7a

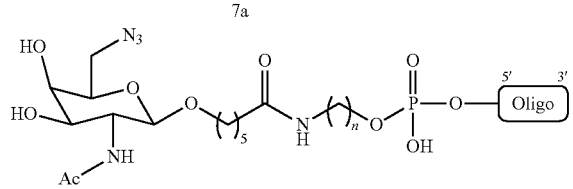

7b

Compounds 2, 3, 4a, 4b, 5a, 5b, and 6 can be conjugated to an oligonucleotide of any sequence, resulting in a combinatorial library of oligonucleotides comprising a GalNAc conjugate, wherein the GalNAc is modified at the C6 position. The C6 position of the final product, compound 7a, comprises a primary amine ($R_5$ and $R_6$=H), an amino acid ($R_5$=H, $R_6$=amino acid) a peptide ($R_5$=H, $R_6$=peptide), or an alkylated amine ($R_5$=—$CH_2$—$R_3$, $R_6$=amino acid, peptide, or —C(O)—$R_4$, wherein $R_3$ and $R_4$ are substituent groups including but not limited to alkyl, alkenyl, and alkynyl groups); or the final product (compound 7b) comprises an azide. In 7a and 7b, n=1, 2, 3, 4, 5, or 6.

Example 2: Synthesis of Oligonucleotides Comprising a GalNAc Modified at the C2 Position
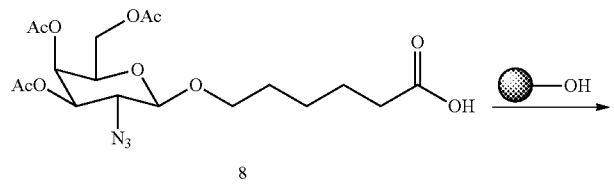
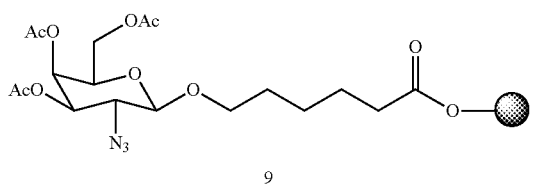
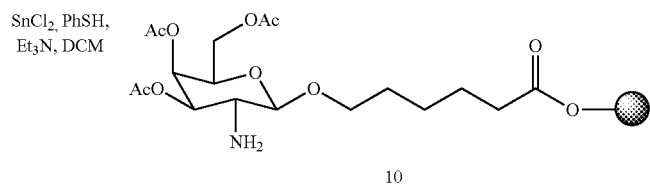
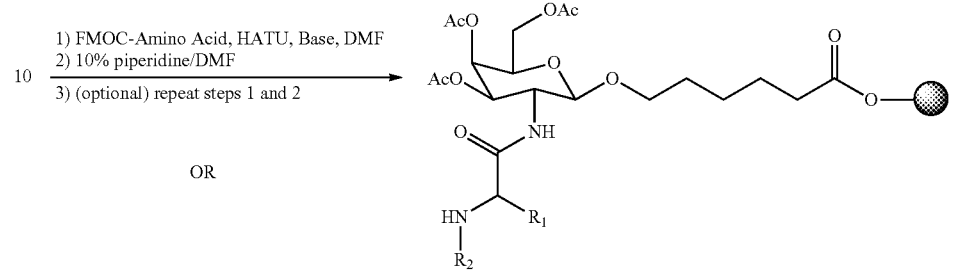
11a: $R_1$ = amino acid side chain, $R_2$ = H
11b: $R_1$ = amino acid side chain, $R_2$ = amino acid(s)
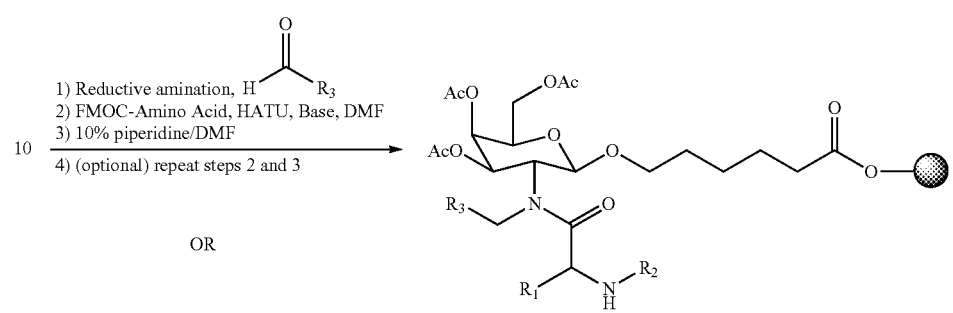
12a: $R_1$ = amino acid side chain, $R_2$ = H
12b: $R_1$ = amino acid side chain, $R_2$ = amino acid(s)
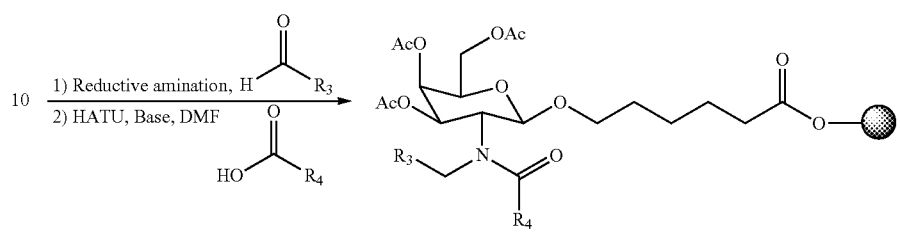
13

-continued 9, 10, 11a, 11b, 12a, 12b, OR 13

1) NaCN, MeOH
2) H$_2$N-oligo

OR

1) CF$_3$COOCOCF$_3$
2) K$_2$CO$_3$
2) PFP-TFA, pyridine
3) Conjugation to H$_2$N-oligo
4) Oligo deprotection

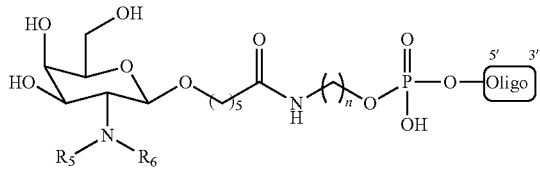

14a

OR

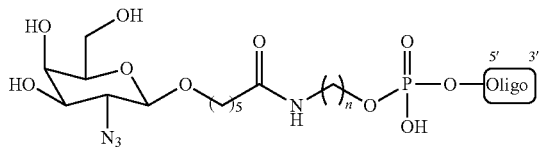

14b

Compounds 9, 10, 11a, 11b, 12a, 12b, and 13 can be conjugated to an oligonucleotide of any sequence, resulting in a combinatorial library of oligonucleotides comprising a GalNAc conjugate, wherein the GalNAc is modified at the C2 position. The C2 position of the final product, compound 14a, comprises a primary amine ($R_5$ and $R_6$=H), an amino acid ($R_5$=H, $R_6$=amino acid) a peptide ($R_5$=H, $R_6$=peptide), or an alkylated amine ($R_5$=—CH$_2$—$R_3$, $R_6$=amino acid, peptide, or —C(O)—$R_4$, wherein $R_3$ and $R_4$ are substituent groups including but not limited to alkyl, alkenyl, and alkynyl groups); or the final product (compound 14b) comprises an azide. In 14a and 14b, n=1, 2, 3, 4, 5, or 6.

Example 3: Synthesis of Oligonucleotides Comprising a GalNAc Modified at the C2 and C6 Positions

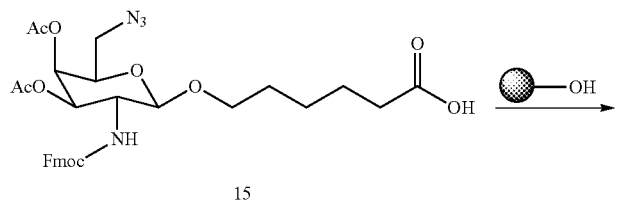

15

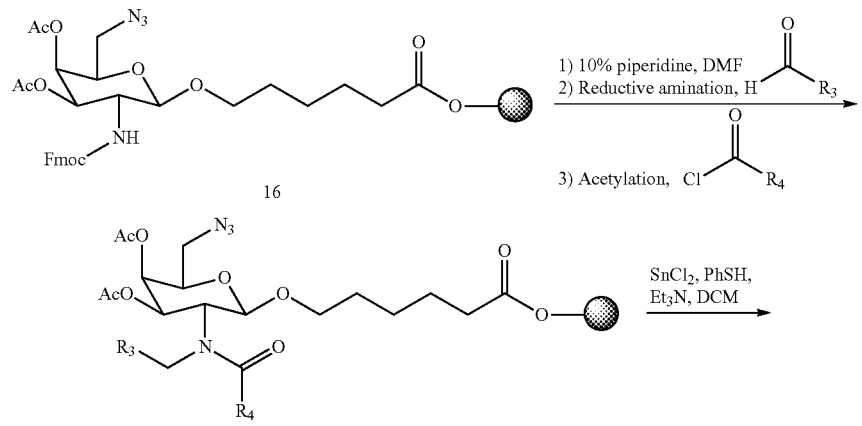

-continued
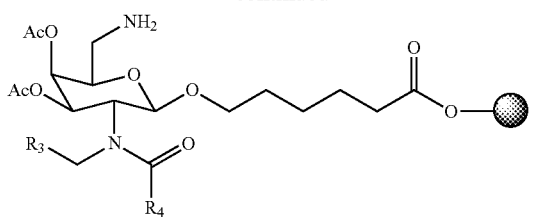
18
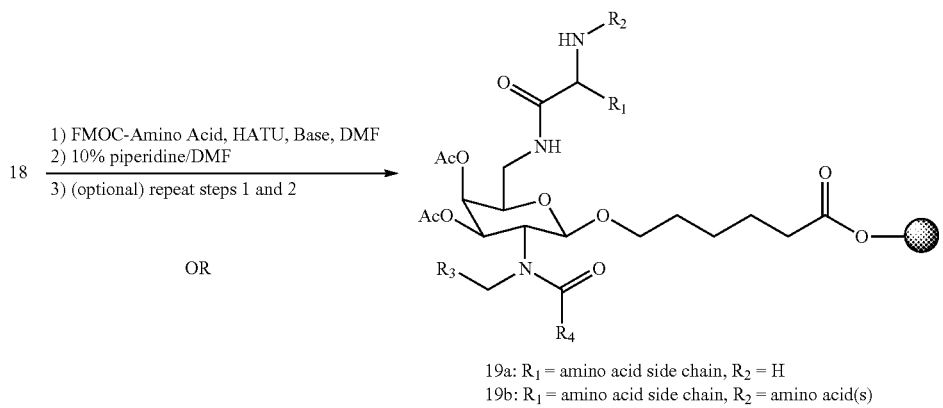
19a: R₁ = amino acid side chain, R₂ = H
19b: R₁ = amino acid side chain, R₂ = amino acid(s)
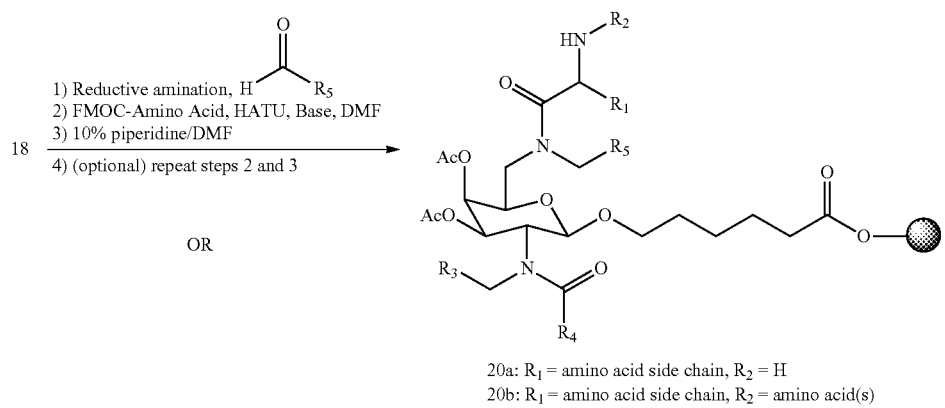
20a: R₁ = amino acid side chain, R₂ = H
20b: R₁ = amino acid side chain, R₂ = amino acid(s)
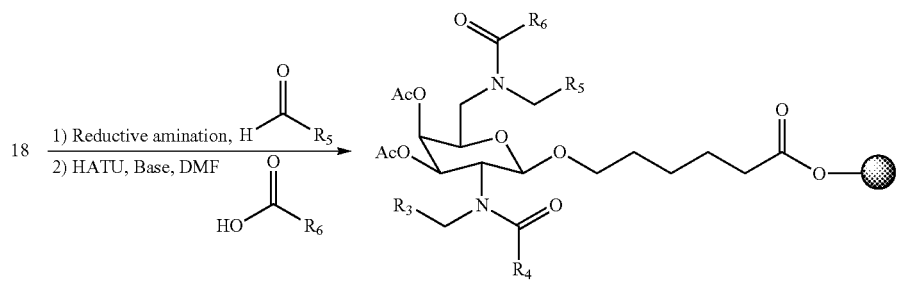
21
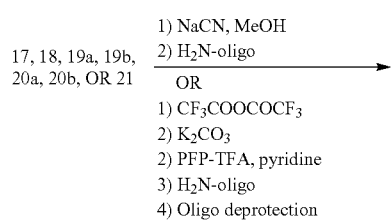

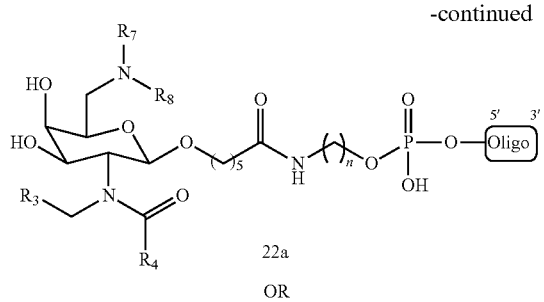

22a

OR

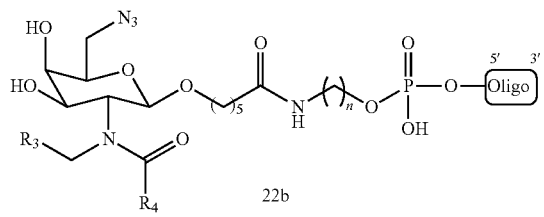

22b

Compounds 17, 18, 19a, 19b, 20a, 20b, and 21 can be conjugated to an oligonucleotide of any sequence, resulting in a combinatorial library of oligonucleotides comprising a GalNAc conjugate, wherein the GalNAc is modified at the C2 and C6 positions. The C6 position of the final product, compound 22a, comprises a primary amine ($R_7$ and $R_8$=H), an amino acid ($R_7$=H, $R_8$=amino acid) a peptide ($R_7$=H, $R_8$=peptide), or an alkylated amine ($R_7$=—$CH_2$—$R_5$, $R_8$=amino acid, peptide, or —C(O)—$R_6$, wherein $R_5$ and $R_6$ are substituent groups including but not limited to alkyl, alkenyl, and alkynyl groups); or the C6 position of the final product (compound 22b) comprises an azide. The C2 position of the final products, compounds 22a and 22b, comprises a substituted amine, wherein $R_3$ and $R_4$ are substituent groups including but not limited to alkyl, alkenyl, and alkynyl groups. In 22a and 22b, n=1, 2, 3, 4, 5, or 6.

Example 4: Synthesis of Oligonucleotides Comprising Three Beta GalNAc Moieties Modified at the Anomeric Positions

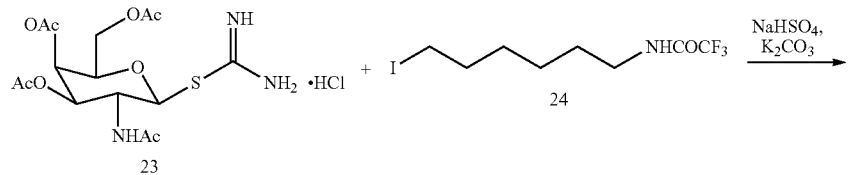

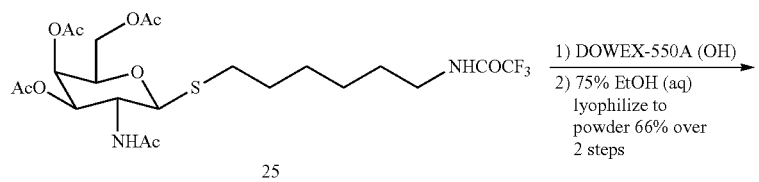

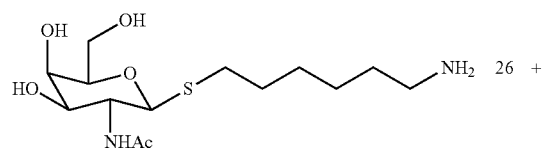

-continued
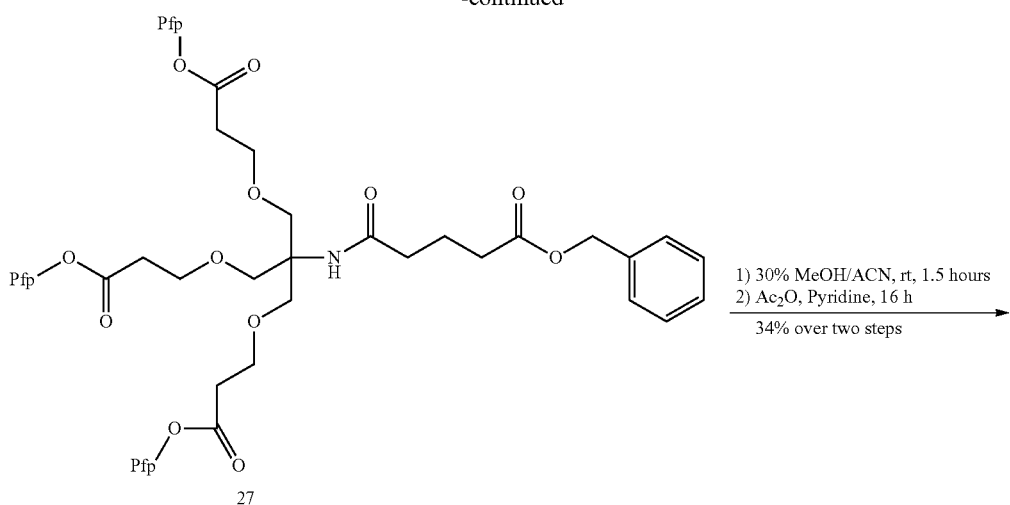
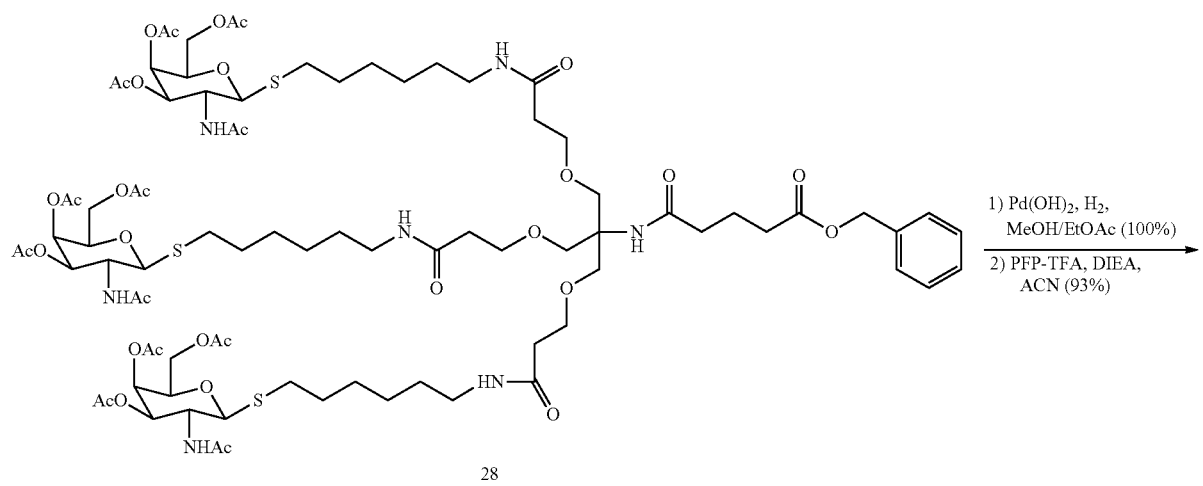
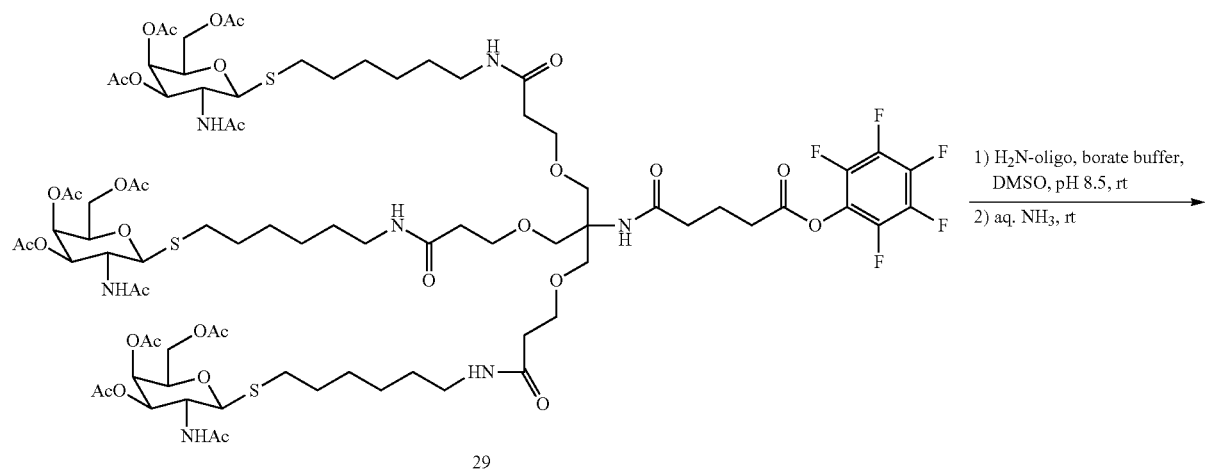

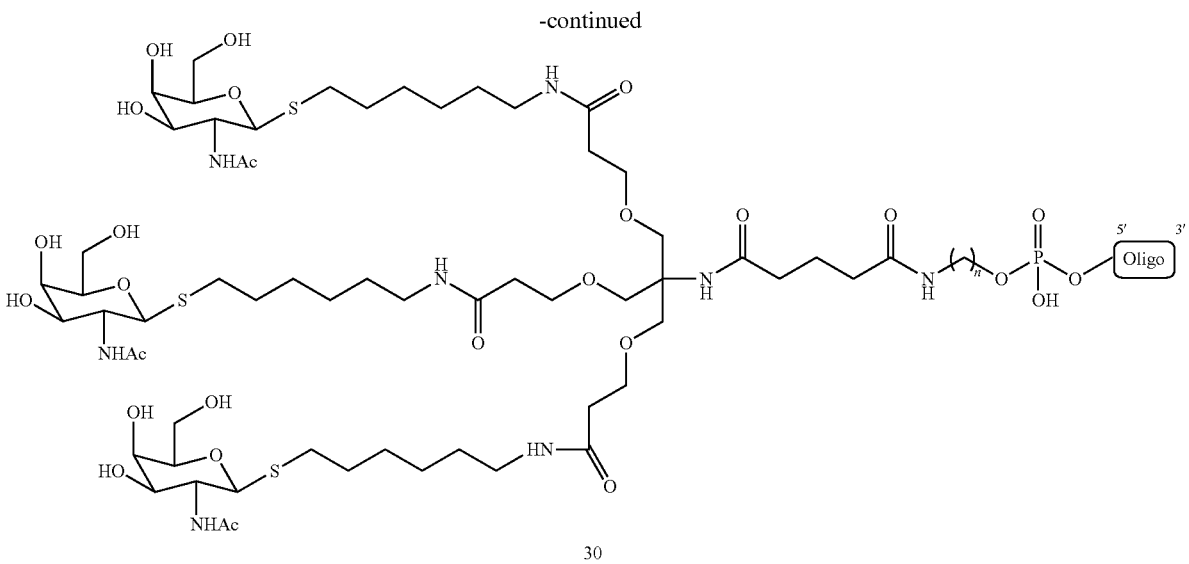

30

Compound 29 can be conjugated to an oligonucleotide of any sequence, resulting in a variety of oligonucleotides represented by compound 30, wherein n=1, 2, 3, 4, 5, or 6. For example, compound 29 was conjugated to a 5'-hexylamino modified antisense oligonucleotide targeting mouse SRB-1 in order to prepare ISIS 709049, an example of compound 30, wherein n=6. The sequence of ISIS 709049 is 5'-AGCTTCAGTCATGACTTCCTT-3' (SEQ ID NO: 141), wherein the cytosines are 5-methylcytosines, and the adenosine at the 5'-end is a 2'-deoxyadenosine that is the cleavable moiety linking the GalNAc conjugate to the oligonucleotide. The internucleoside linkages are phosphorothioate except for the linkage between the deoxyadenosine and guanosine, which is a phosphodiester linkage. The twenty phosphorothioate linked nucleotides of ISIS 709049 comprise a gapmer, wherein the wings comprise 2'-methoxyethyl (MOE) modifications and are each five nucleotides in length. The gap comprises 2'-deoxynucleotides and is 10 nucleotides in length.

Example 5: Synthesis of Oligonucleotides Comprising Three Alpha GalNAc Moieties Modified at the Anomeric Positions

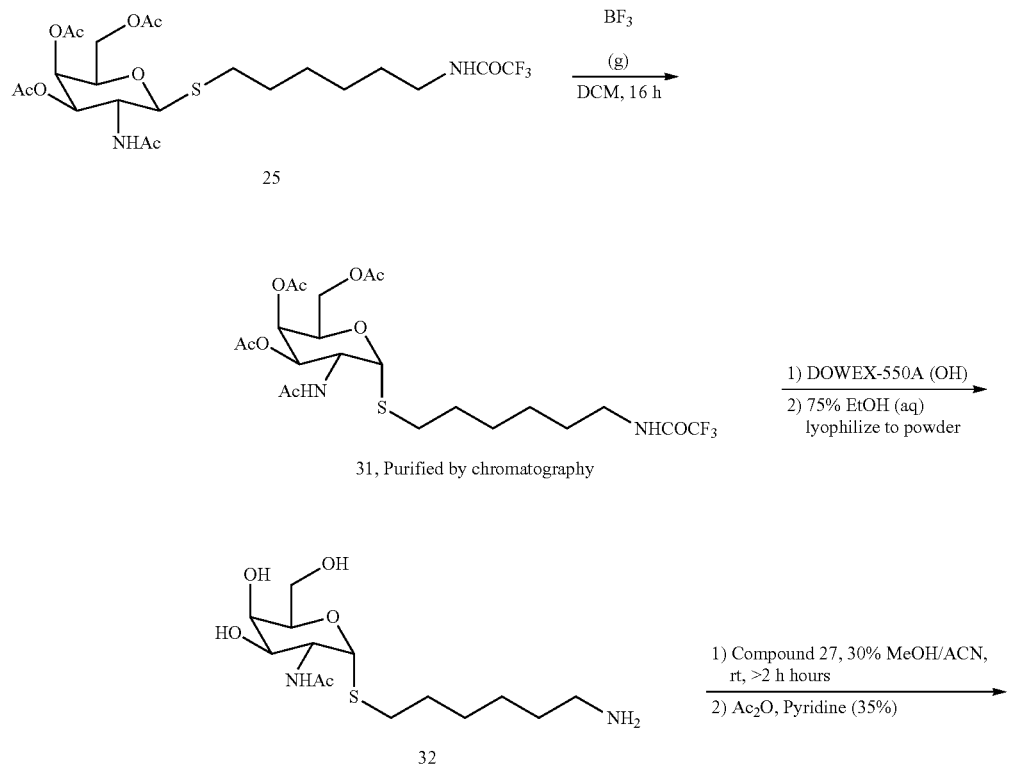

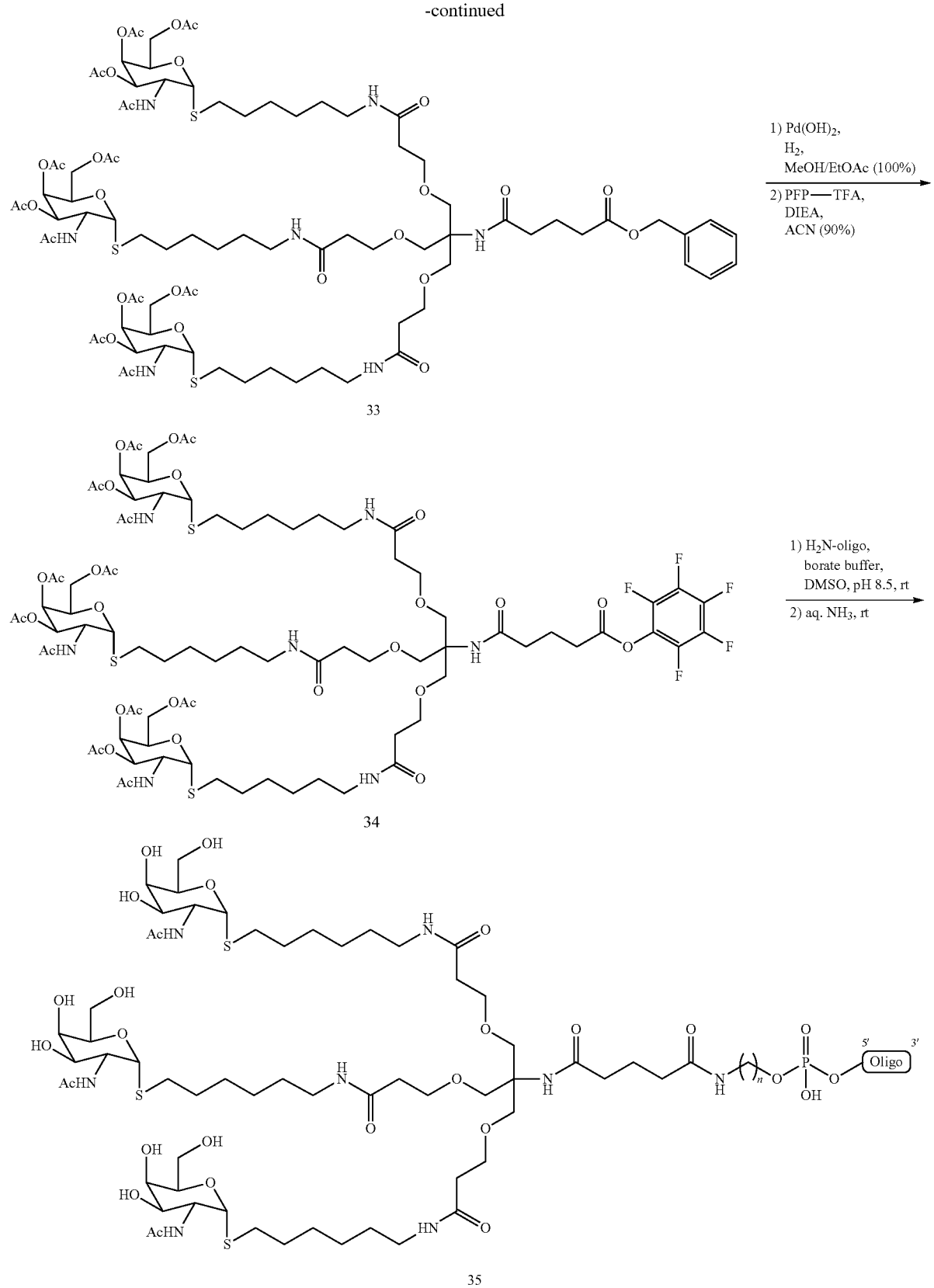
Compound 34 can be conjugated to an oligonucleotide of any sequence, resulting in a variety of oligonucleotides represented by compound 35, wherein n=1, 2, 3, 4, 5, or 6. For example, compound 34 was conjugated to a 5'-hexylamino modified antisense oligonucleotide targeting mouse SRB-1 in order to prepare ISIS 720333, an example of compound 35, wherein n=6. The sequence of ISIS 720333 is 5'-AGCTTCAGTCATGACTTCCTT-3' (SEQ ID NO: 141), wherein the cytosines are 5-methylcytosines, and the adenosine at the 5'-end is a 2'-deoxyadenosine that is the cleavable moiety linking the GalNAc conjugate to the oligonucleotide. The internucleoside linkages are phosphorothioate except for the linkage between the deoxyadenosine and guanosine, which is a phosphodiester linkage. The twenty phosphorothioate linked nucleotides of ISIS 720333 comprise a gapmer, wherein the wings comprise 2'-methoxyethyl (MOE) modifications and are each five nucleotides in length. The gap comprises 2'-deoxynucleotides and is 10 nucleotides in length.

Example 6: Synthesis of Oligonucleotides Comprising a Beta GalNAc Modified at the Anomeric Position

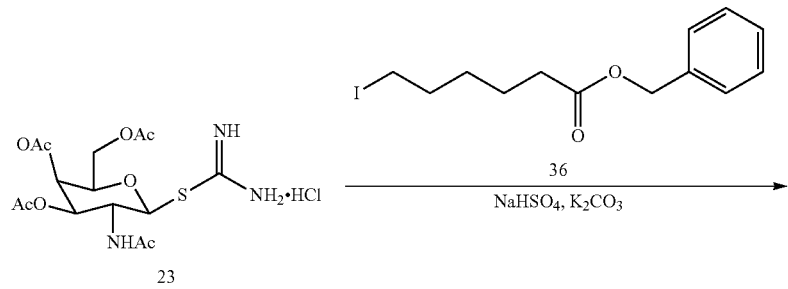

23

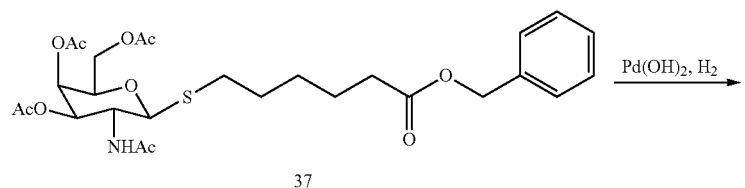

37

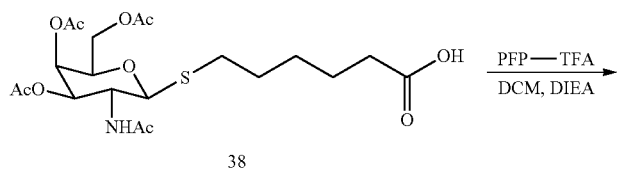

38

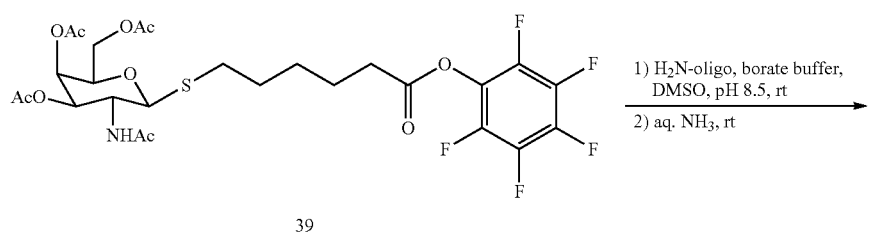

39

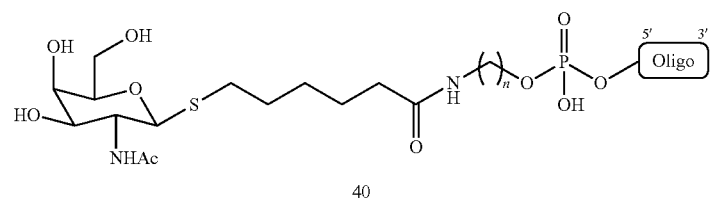

40

Compound 39 can be conjugated to an oligonucleotide of any sequence. In the final product, compound 40, n is 1, 2, 3, 4, 5, or 6. Alternatively, compound 44 below can be conjugated to the 5'-end of an oligonucleotide of any sequence using an automated oligonucleotide synthesizer, resulting in a variety of oligonucleotides represented by compound 45 below.
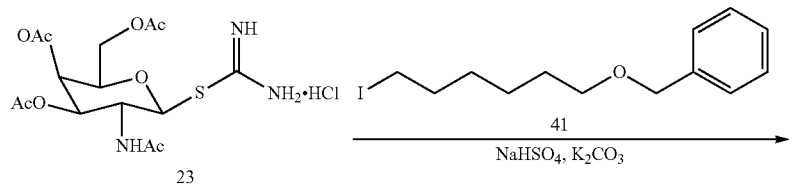
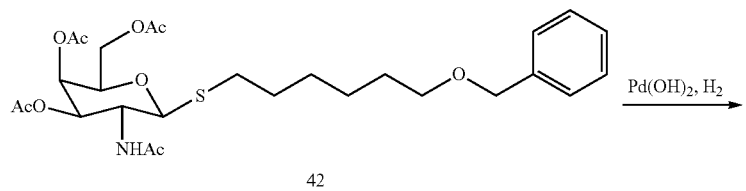
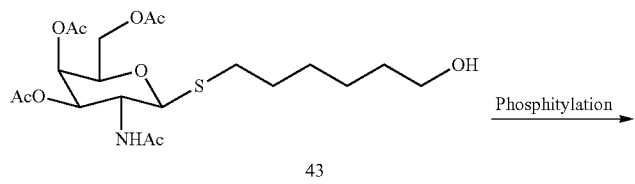
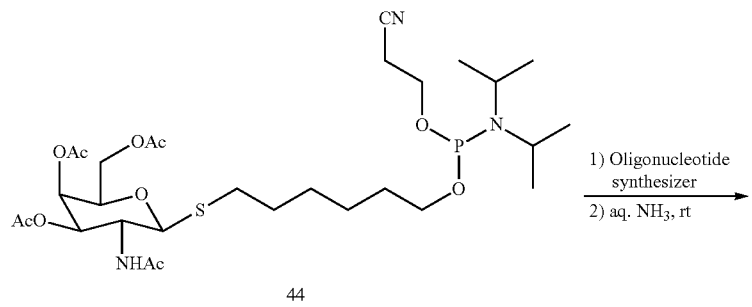
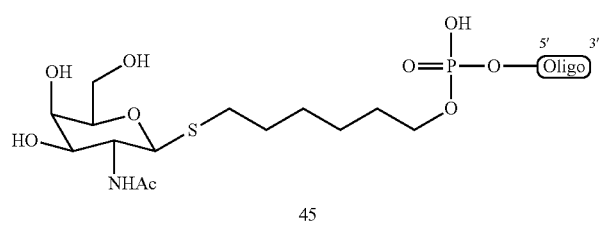

Example 7: Synthesis of Oligonucleotides Comprising an Alpha GalNAc Modified at the Anomeric Position

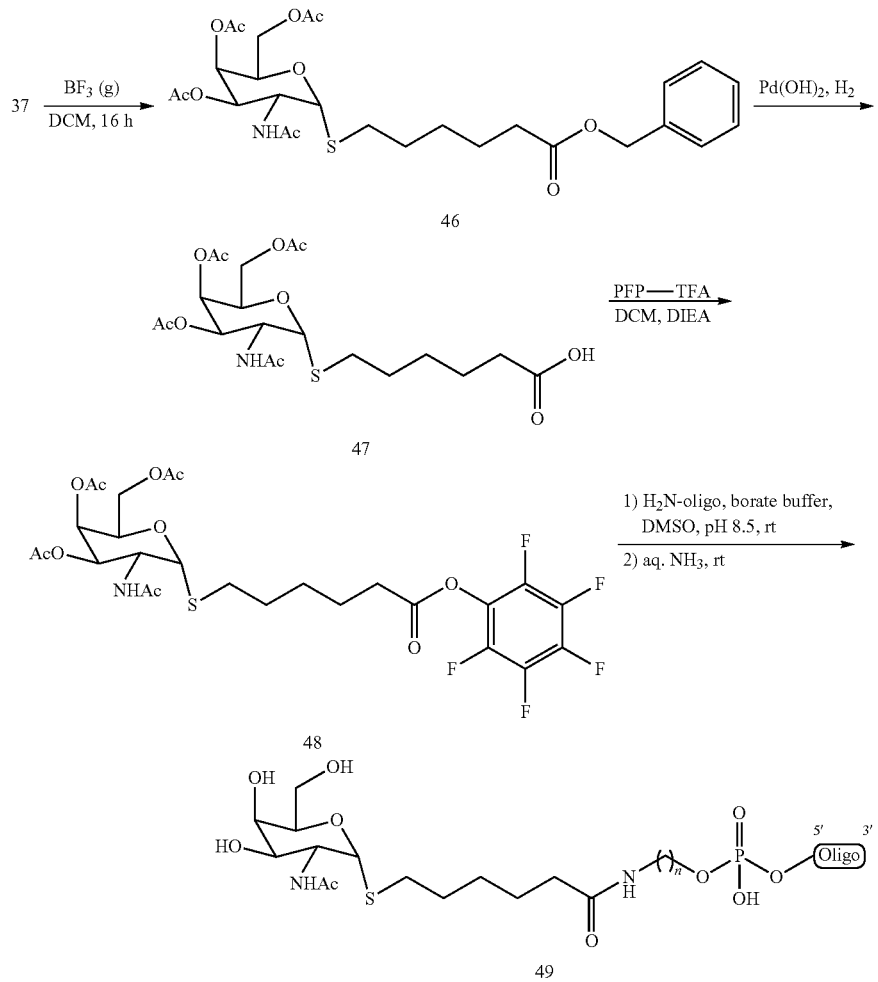

Compound 48 can be conjugated to an oligonucleotide of any sequence. In the final product, compound 49, n is 1, 2, 3, 4, 5, or 6. Alternatively, compound 52 below can be conjugated to the 5'-end of an oligonucleotide of any sequence using an automated oligonucleotide synthesizer, resulting in a variety of oligonucleotides represented by compound 53 below.

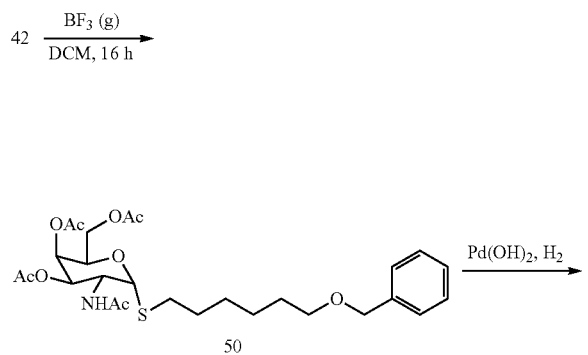

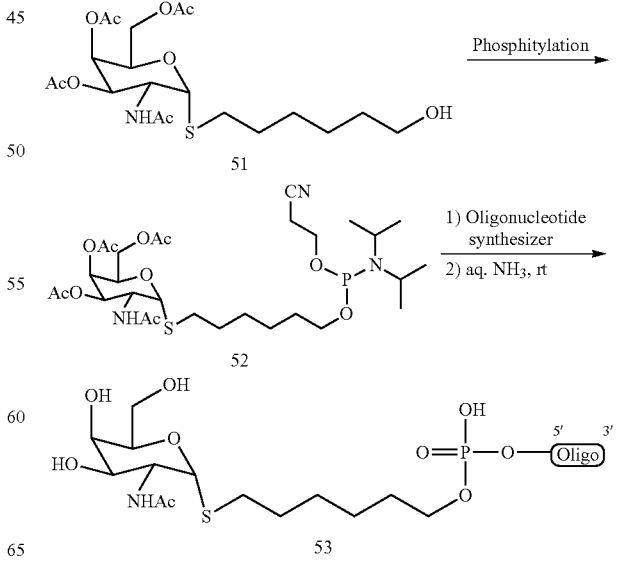

Example 8: Synthesis of Oligonucleotides Comprising Three GalNAc Moieties Modified to Comprise a Triazole at the C6 Positions
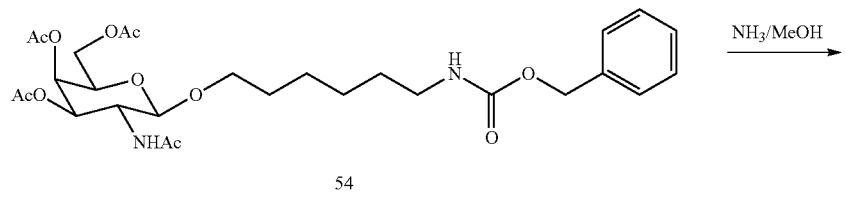
54
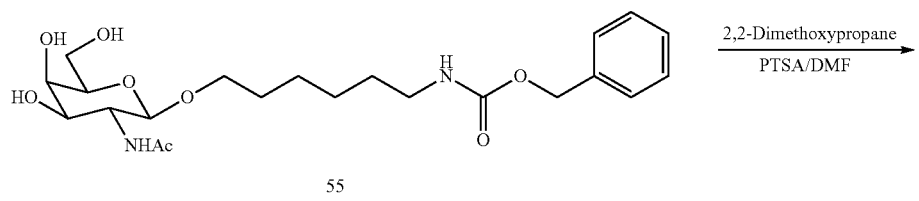
55
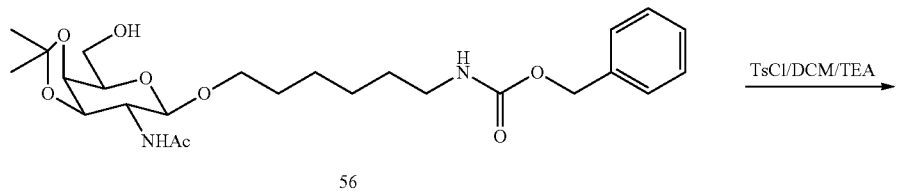
56
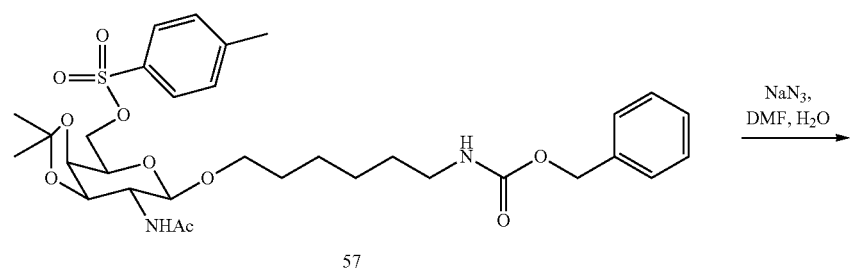
57
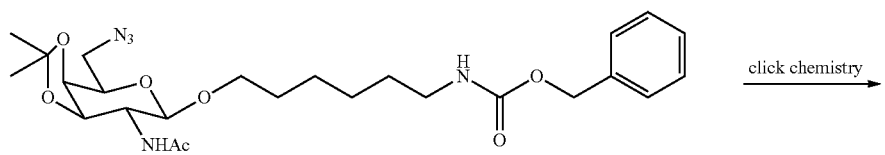
58
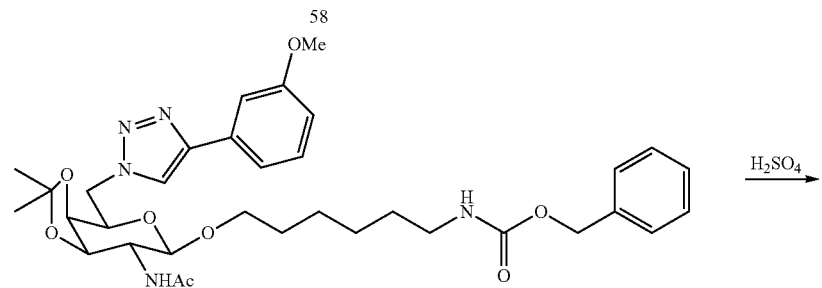
59

-continued
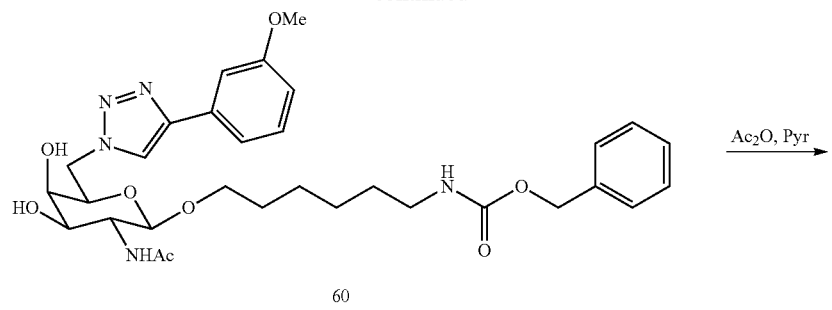
60
Ac₂O, Pyr →
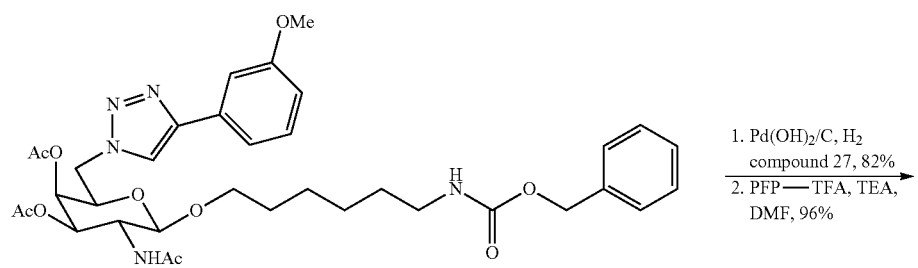
61
1. Pd(OH)₂/C, H₂ compound 27, 82%
2. PFP—TFA, TEA, DMF, 96%
→
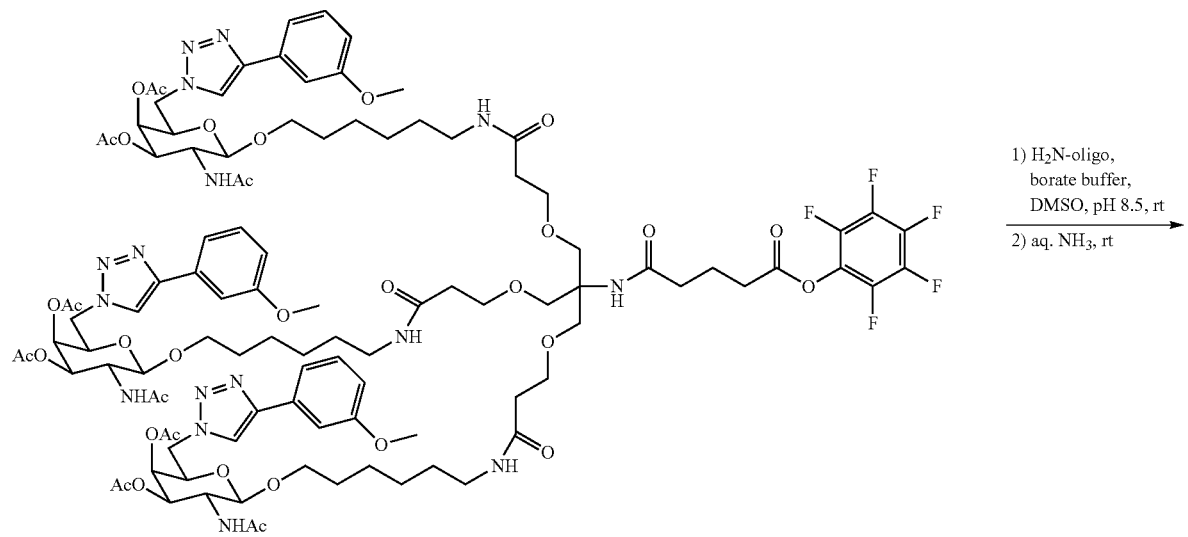
62
1) H₂N-oligo, borate buffer, DMSO, pH 8.5, rt
2) aq. NH₃, rt
→

-continued

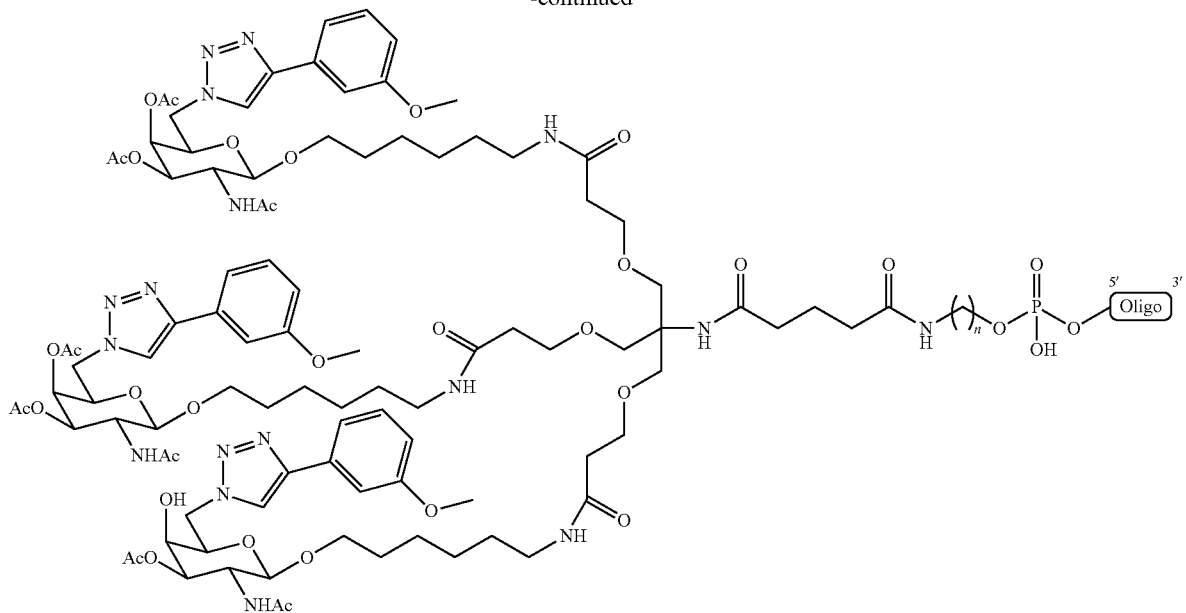

63

Compound 54 (5 g, 8.7 mmol) was dissolved in 7 N NH₃ in MeOH (30 mL) in a sealed 150 mL round-bottom flask and stirred at room temperature for 12 h. The clear solution became a thick white suspension. The reaction mixture was concentrated to dryness to yield a white solid, compound 55 (quantitative yield). Structure was confirmed by LCMS, $^1$H NMR and $^{13}$C NMR analysis.

Compound 55 (3.9 g, 8.5 mmol), p-Toluenesulfonic acid monohydrate (0.15 g, 0.79 mmol) and 2,2-Dimethoxypropane (15 mL, 121.8 mmol) were suspended in DMF (20 mL) and stirred at room temperature for 12 h. 50% aqueous acetic acid (10 mL) was added and stirring continued for additional h. Solvent was removed under reduced pressure, and the residue was dissolved in 10% MeOH in DCM (200 mL) and washed with aqueous saturated NaHCO₃ solution and brine, dried (Na₂SO₄), filtered and concentrated. The residue was purified by silica gel column chromatography and eluted first with 50% ethyl acetate in DCM (5 CV), then with 100% ethyl acetate (10 CV) to yield compound 56 (1.83 g, 43.5%). Structure was confirmed by LCMS, $^1$H NMR and $^{13}$C NMR analysis.

To a solution of compound 56 (4.1 g, 8.3 mmol) in dichloromethane (50 mL), triethylamine (3.5 mL, 18.3 mmol) was added and the reaction mixture was cooled in an ice bath. To this, a solution of p-toulenesulfonyl chloride (3.5 g, 18.3 mmol) in dichloromethane ion (30 mL) was added. The reaction mixture was allowed to come to room temperature and stirred for 72 h. The reaction was diluted with dichloromethane and washed with aqueous saturated NaHCO₃ solution and brine, dried (Na₂SO₄), filtered and concentrated to yield compound 57 (6.82 g). The structure was confirmed by LCMS, $^1$H NMR and $^{13}$C NMR analysis.

To a solution of compound 57 (5.4 g, 8.3 mmol) in DMSO (40 mL) NaN₃ (6.8 g, 105 mmol) and water (6 mL) were added and the solution was heated at 100° C. for 25 h. The reaction mixture was diluted with ethyl acetate and with aqueous saturated NaHCO₃ solution and brine, dried (Na₂SO₄), filtered and concentrated. The residue obtained was purified silica gel column chromatography and eluted with 10-40% acetone in dichloromethane to yield compound 58 (3.35 g, 77.6%). Structure was confirmed by LCMS, $^1$H NMR and $^{13}$C NMR analysis.

To a solution of 3-ethynylanisole (0.88 mL, 6.9 mmol) and compound 58 (3 g, 5.8 mmol) in MeOH (20 mL), TBTA (tris[(1-benzyl-1H-1,2,3-triazol-4-yl)methyl]amine (0.15 g, 0.29 mmol), CuSO4.5H2O (0.014 g, 0.058 mmol) in water (2 mL, reaction became blue solution), and (+)-Sodium L-ascorbate (0.11 g, 0.58 mmol) in water (1 ml, reaction color changed to yellow) were added. The reaction was vigorously stirred for 12 h at room temperature, and concentrated to dryness. The residue was the dissolved in dichloromethane (100 mL) and washed with water (50 mL×3). The organic phase was separated and the aqueous phase was further extracted with (2×10 mL). The combined organic fractions were concentrated and the residue was purified by Biotage silica gel (100 g) chromatography that eluted with 15% (6CV), 20% (6CV), 25% (6CV) and 30% (6CV) acetone in dichloromethane to yield compound 59 (3.6 g, 95.7%). Structure was confirmed by LCMS, $^1$H NMR and $^{13}$C NMR analysis.

Compound 59 (3.35 g, 5.14 mmol) was dissolved in acetonitrile (57 mL) and aqueous H₂SO₄ (1.84%, 43 mL) was added. The mixture was stirred at room temperature for 96 h. The reaction mixture was extracted with ethyl acetate and washed with aqueous saturated NaHCO₃ and brine. The organic phase was concentrated to dryness and the crude product was purified through silica gel column and eluted with 2-10% MeOH in dichloromethane to yield compound 60 (2.92 g, 93%). Structure was confirmed by LCMS, $^1$H NMR and $^{13}$C NMR analysis.

Compound 60 (1.78 g, 2.9 mmol) was dissolved in anhydrous pyridine (45 mL) and to this acetic anhydride (2.75 mL, 29 mmol) was added. The reaction mixture was stirred at room temperature for 12 h and then at 50° C. for 3 h. The reaction mixture was extracted with dichloromethane (150 mL) and the dichloromethane phase was washed with aqueous saturated sodium solution (100 mL), brine (100 mL), 2N HCl (100 mL) and brine (100 mL). The organic phase was dried over Na$_2$SO$_4$, filtered and concentrated to dryness. The residue was purified by silica gel column chromatography and eluted with 1-5% MeOH in dichloromethane to yield compound 61 (1.96 g, 96.8%). Structure was confirmed by LCMS, $^1$H NMR and $^{13}$C NMR analysis.

Compound 61 (1.62 g, 2.31 mmol) and compound 27 (0.8 g, 0.77 mmol) were dissolved in THF (16 mL). To this mixture, Pd(OH)$_2$ (0.28 g) was added. The reaction mixture was stirred at room temperature for 3 h. The suspension was filtered through a pad of Celite and washed with THF. The organic phase were combined and concentrated to dryness under reduced pressure. The residue was purified by silica gel chromatography and eluted with 5-20% MeOH in dichloromethane to yield tri-antinary cluster acid (1.12 g, 70%). The cluster acid (1 g, 0.48 mmol) and TEA (0.2 mL, 1.44 mmol) were dissolved in dichloromethane (10 mL) and PFP-TFA (0.16 mL, 0.96 mmol) was added. After two h, the reaction mixture was diluted with dichloromethane and washed with 1N NaHSO$_4$ (30 mL×2), brine (30 mL); aqueous saturated sodium bicarbonate (30 mL×2), and brine (30 mL). The resulting solution was dried over Na$_2$SO$_4$, filtered and concentrated to dryness under reduced pressure to yield compound 62 (1.05 g, 97%). Structure was confirmed by LCMS, $^1$H NMR and $^{13}$C NMR analysis.

Compound 62 can be conjugated to an oligonucleotide of any sequence, resulting in a variety of oligonucleotides represented by compound 63, wherein n=1, 2, 3, 4, 5, or 6.

Example 9: Synthesis of Oligonucleotides Comprising a GalNAc Modified to Comprise a Triazole at the C6 Position

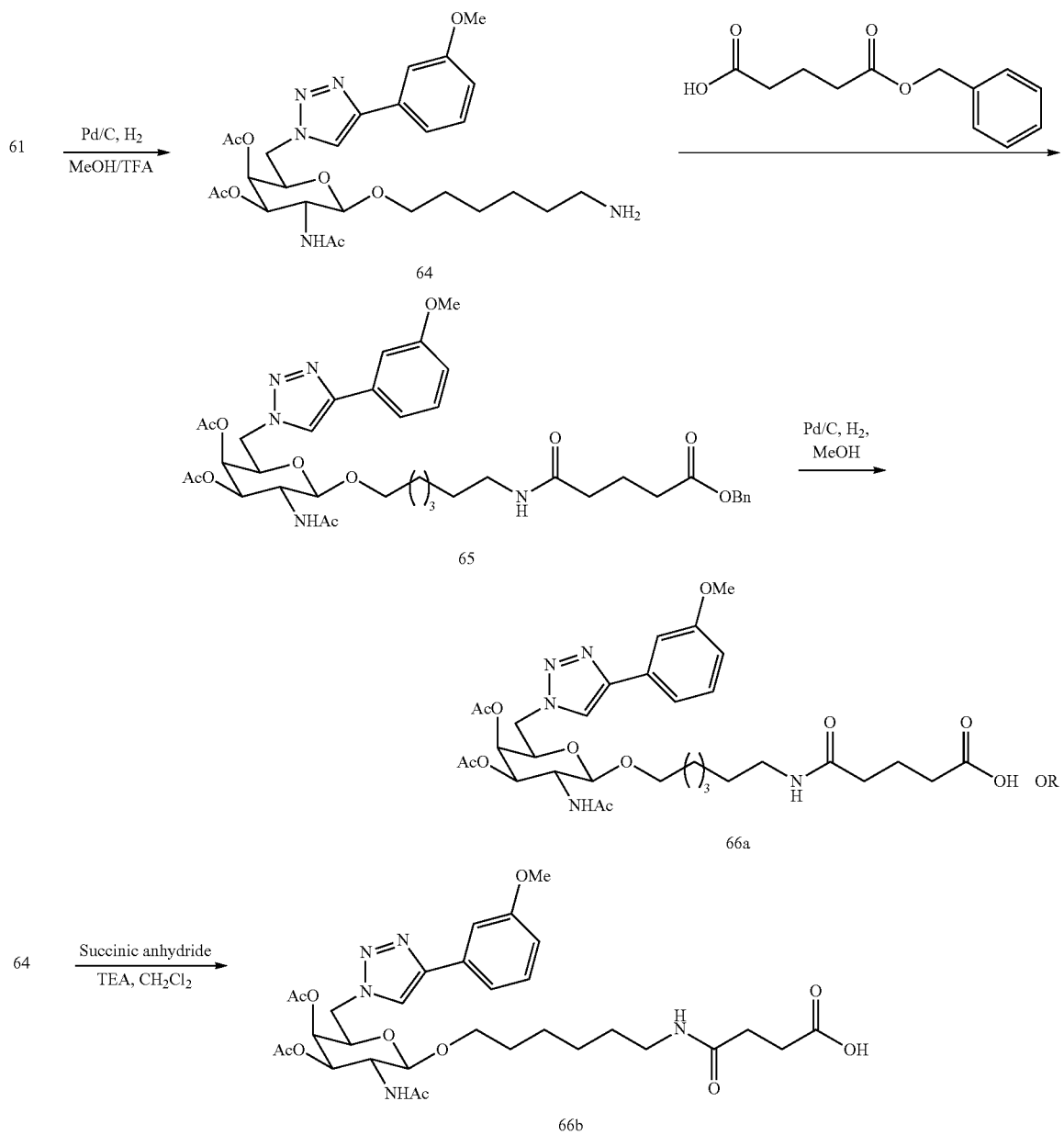

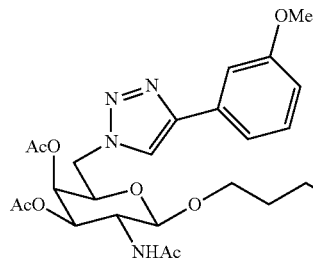

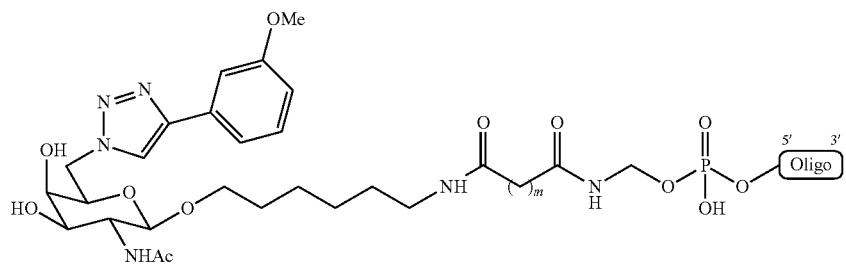

Compounds 67a and 67b can be conjugated to an oligonucleotide of any sequence, resulting in a variety of oligonucleotides represented by compounds 68a and 68b, wherein n=1, 2, 3, 4, 5, or 6. Alternatively, compound 69 below can be conjugated to the 5'-end of an oligonucleotide of any sequence using an automated oligonucleotide synthesizer, resulting in a variety of oligonucleotides represented by compound 70 below.

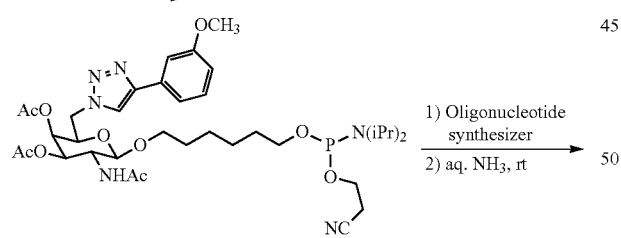

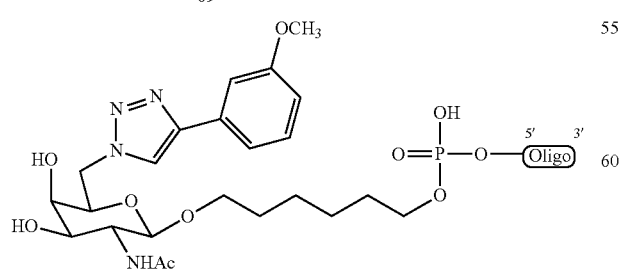

Example 10: Synthesis of Oligonucleotides Comprising a GalNAc Modified to Comprise an Amide at the C6 Position
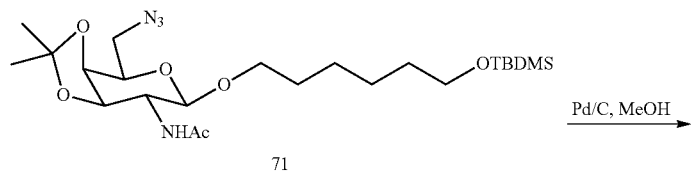
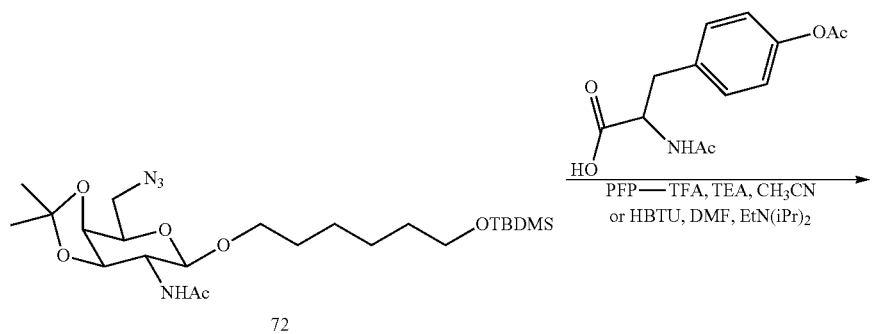
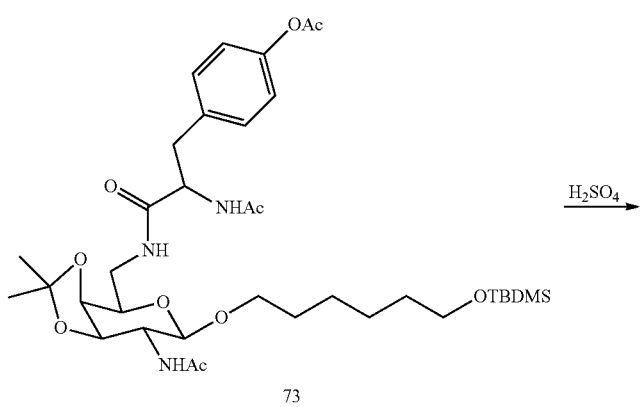
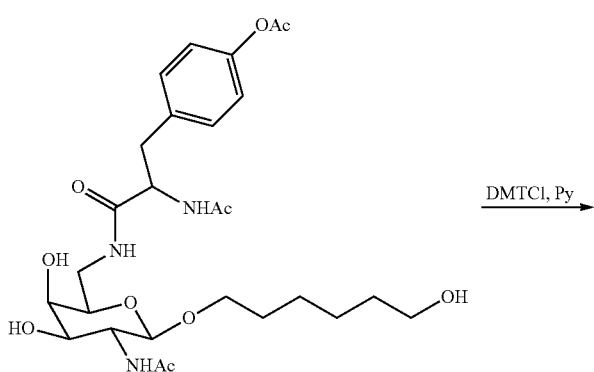

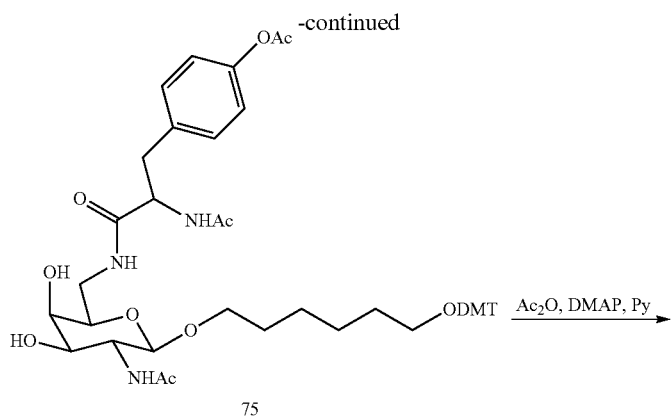
75
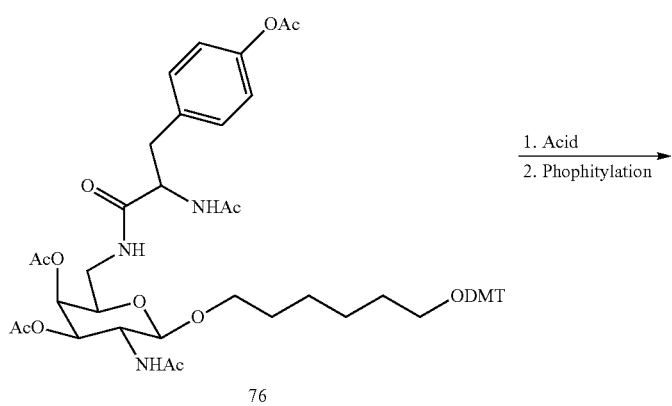
76
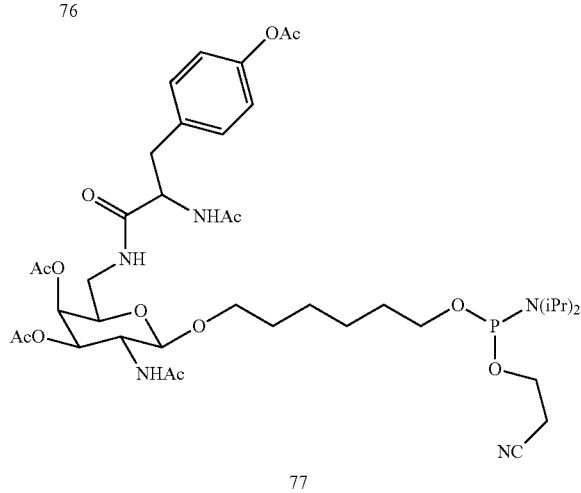
77
Compound 77 can be conjugated to the 5'-end of an oligonucleotide of any sequence using an automated oligonucleotide synthesizer, resulting in a variety of oligonucleotides.
Example 11: Synthesis of Oligonucleotides Comprising a GalNAc Modified to Comprise an Indole Moiety at the C6 Position
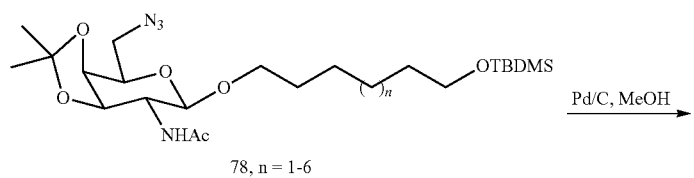
78, n = 1-6

-continued
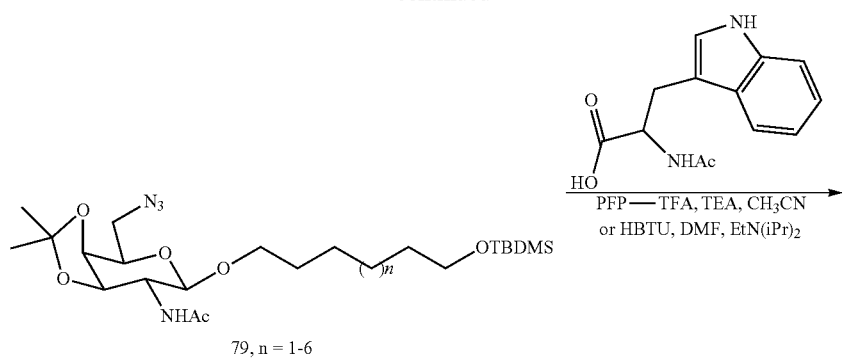
79, n = 1-6
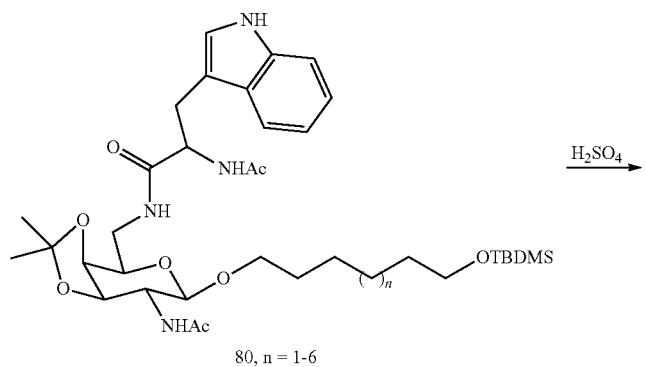
80, n = 1-6
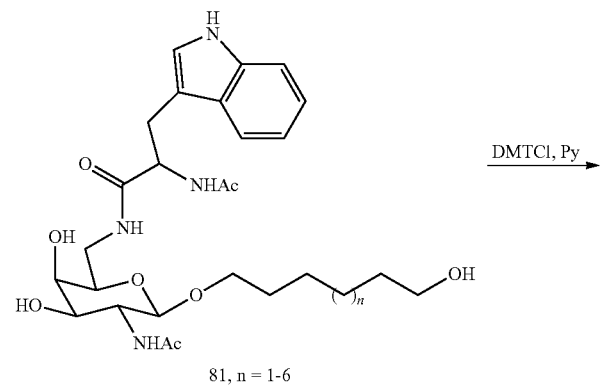
81, n = 1-6
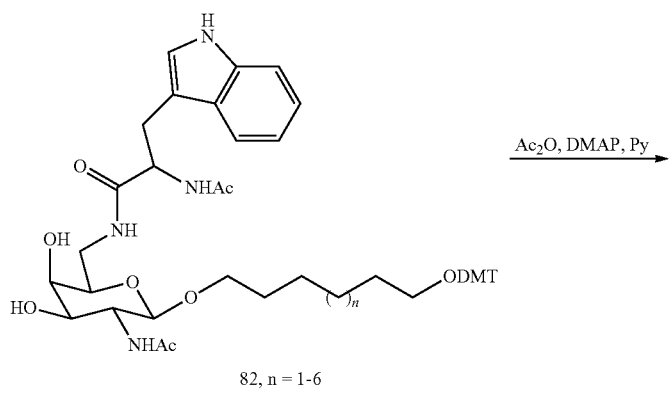
82, n = 1-6

-continued

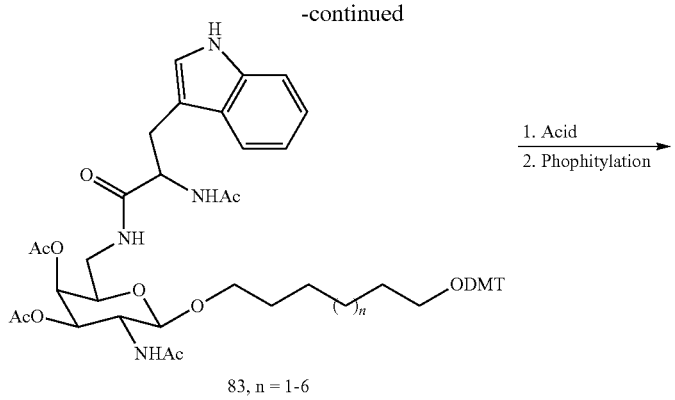

83, n = 1-6

1. Acid
2. Phophitylation →

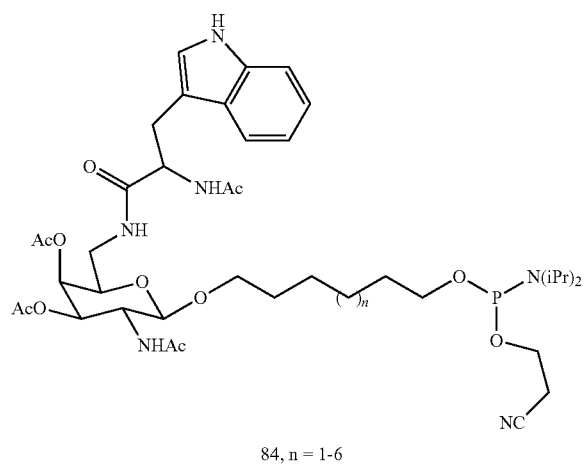

84, n = 1-6

Compound 84 can be conjugated to the 5'-end of an oligonucleotide of any sequence using an automated oligonucleotide synthesizer, resulting in a variety of oligonucleotides.

Example 12: Synthesis of Oligonucleotides Comprising a GalNAc Modified to Comprise an Azide at the C6 Position 78 $\xrightarrow{H_2SO_4}$

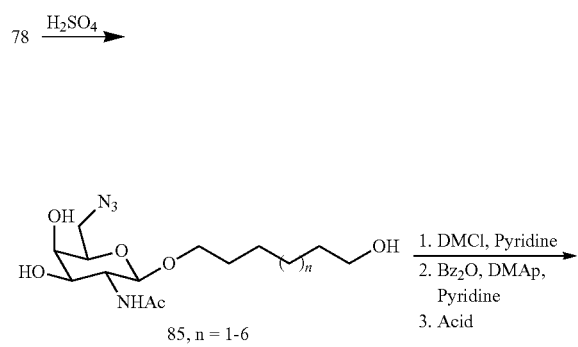

85, n = 1-6

1. DMCl, Pyridine
2. Bz$_2$O, DMAp, Pyridine
3. Acid

-continued

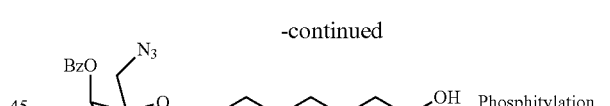

86, n = 1-6

Phosphitylation →

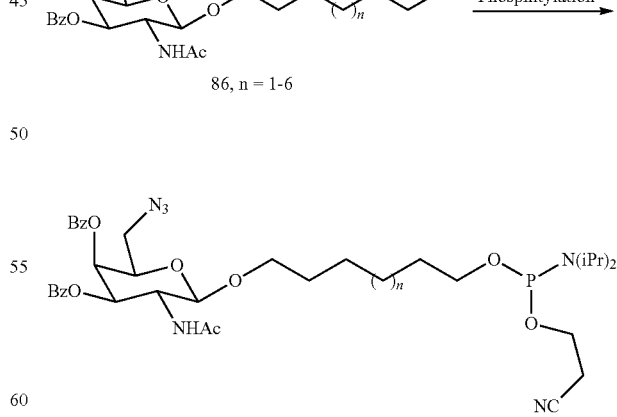

87, n = 1-6

Compound 87 can be conjugated to the 5'-end of an oligonucleotide of any sequence using an automated oligonucleotide synthesizer, resulting in a variety of oligonucleotides.

Example 13: Synthesis of Oligonucleotides Comprising a GalNAc Modified to Comprise a Triazole at the C6 Position
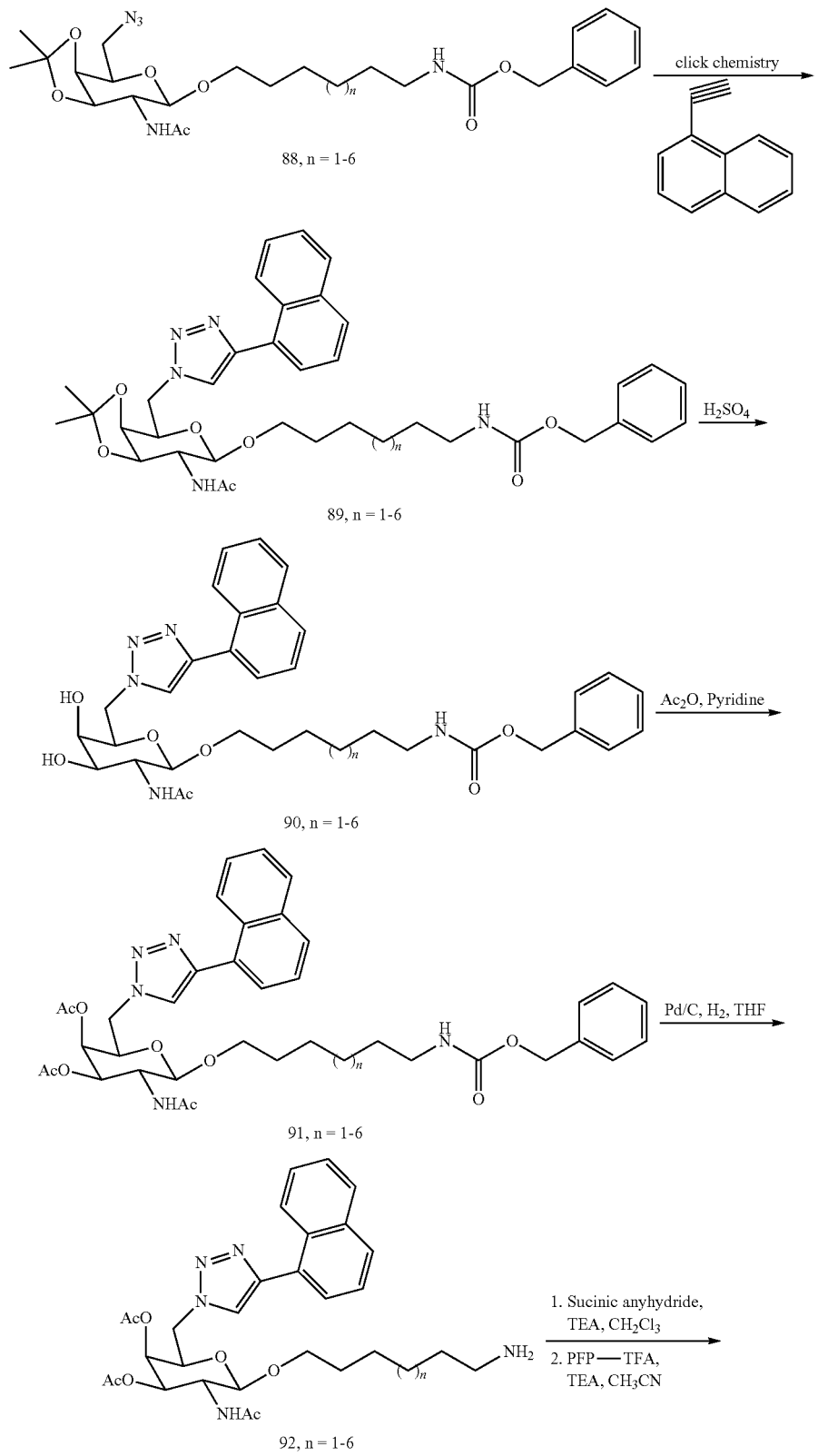

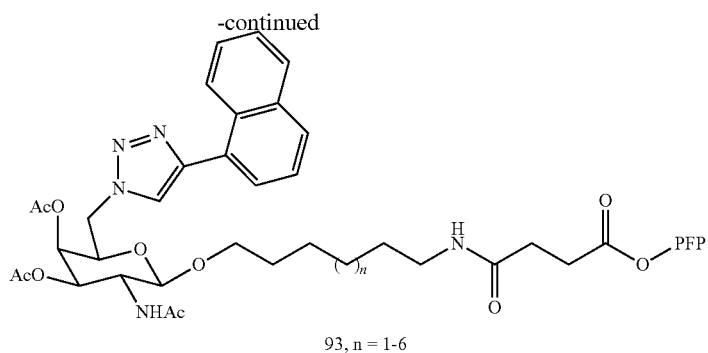

93, n = 1-6

Compound 93 can be conjugated to an oligonucleotide of any sequence, resulting in a variety of oligonucleotides. Alternatively, compound 94 below can be conjugated to the 5'-end of an oligonucleotide of any sequence using an automated oligonucleotide synthesizer, resulting in a variety of oligonucleotides.

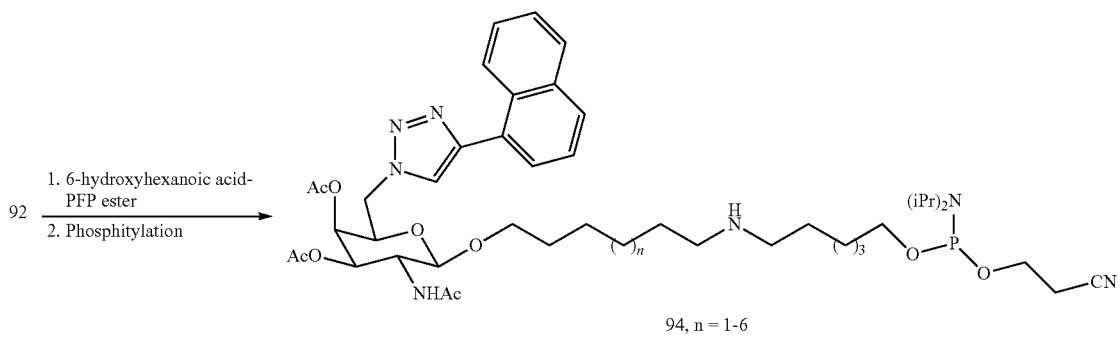

94, n = 1-6

Example 14: Synthesis of Oligonucleotides Comprising a GalNAc Modified to Comprise an Amide at the C6 Position

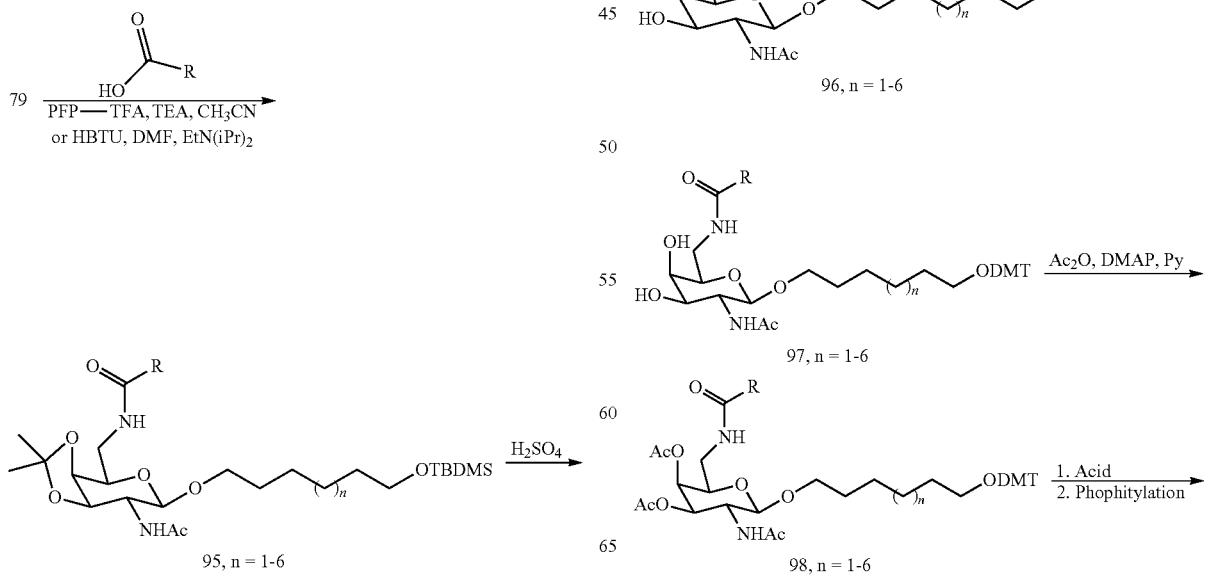

233

-continued

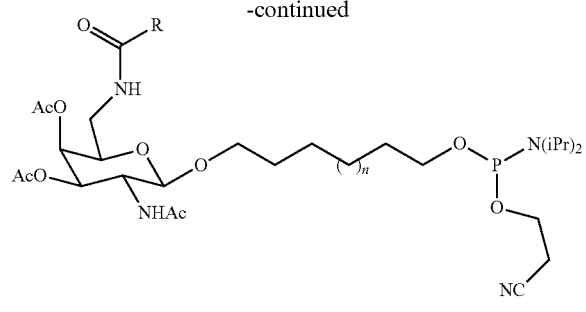

99, n = 1-6 wherein R =

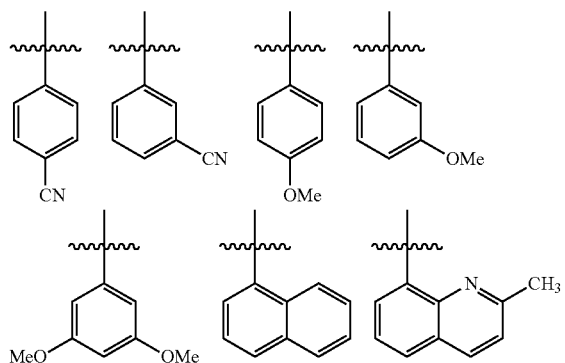

234

-continued

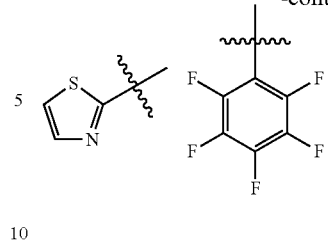

Using the method shown in the scheme above, a variety of GalNAc moieties modified to comprise an amide at the C6 position can be prepared, represented by compound 99. Phosphoramidite 99 can be conjugated to the 5'-end of an oligonucleotide of any sequence using an automated oligonucleotide synthesizer, resulting in a variety of oligonucleotides. Alternatively, the pentafluorophenyl ester of compound 98 can be synthesized and conjugated to an oligonucleotide of any sequence, resulting in a variety of oligonucleotides.

Example 15: Synthesis of Oligonucleotides Comprising Three GalNAc Moieties Modified to Comprise an Amide at the C6 Position

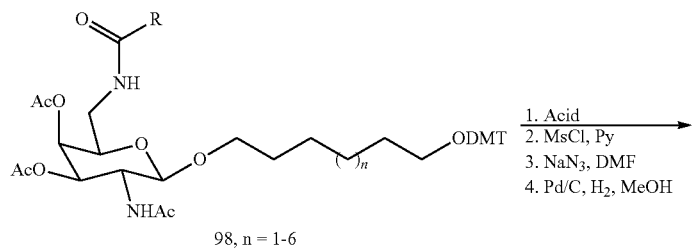

98, n = 1-6

1. Acid
2. MsCl, Py
3. NaN₃, DMF
4. Pd/C, H₂, MeOH

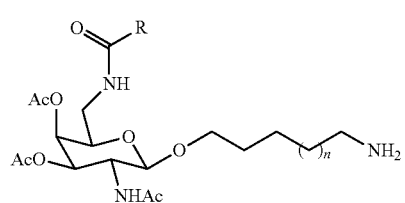

100, n = 1-6

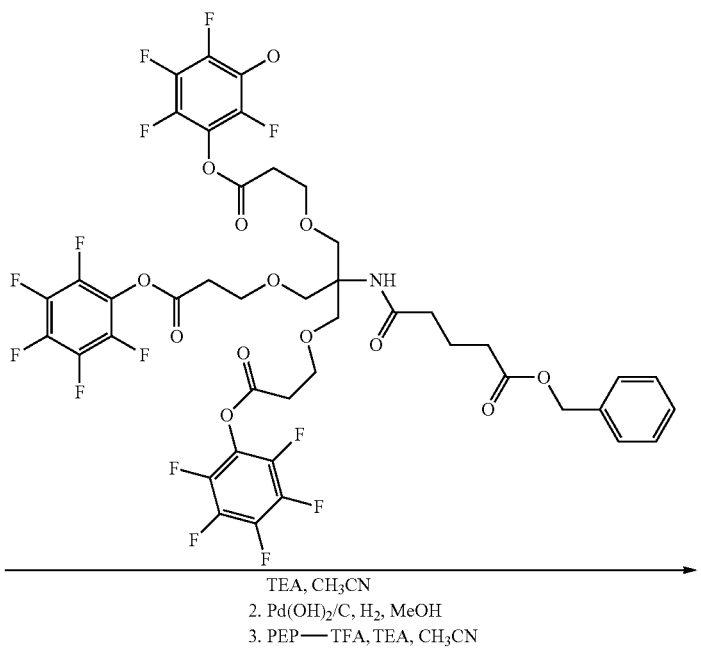

1. TEA, CH₃CN
2. Pd(OH)₂/C, H₂, MeOH
3. PFP—TFA, TEA, CH₃CN

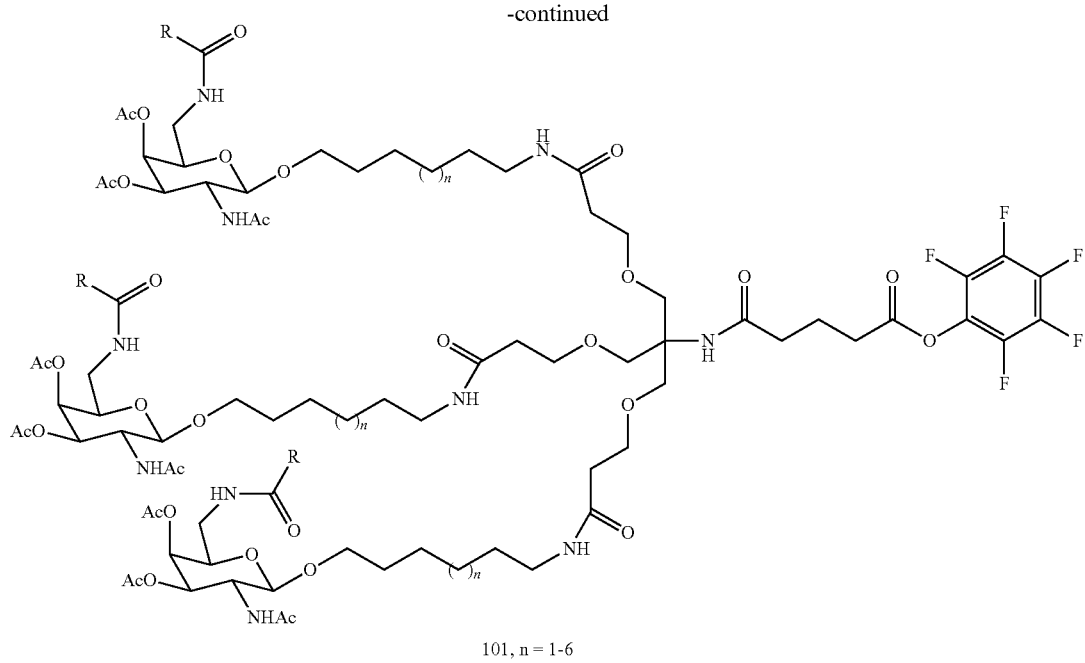

101, n = 1-6 wherein R =

Using the method shown in the scheme above, a variety of trivalent GalNAc moieties modified to comprise an amide at the C6 position can be prepared, represented by compound 101. Compound 101 can be conjugated to an oligo nucleotide of any sequence, resulting in a variety of oligonucleotides, wherein n=1, 2, 3, 4, 5, or 6.

Example 16: Synthesis of Oligonucleotides Comprising a GalNAc Modified to Comprise a Triazole at the C2 Position

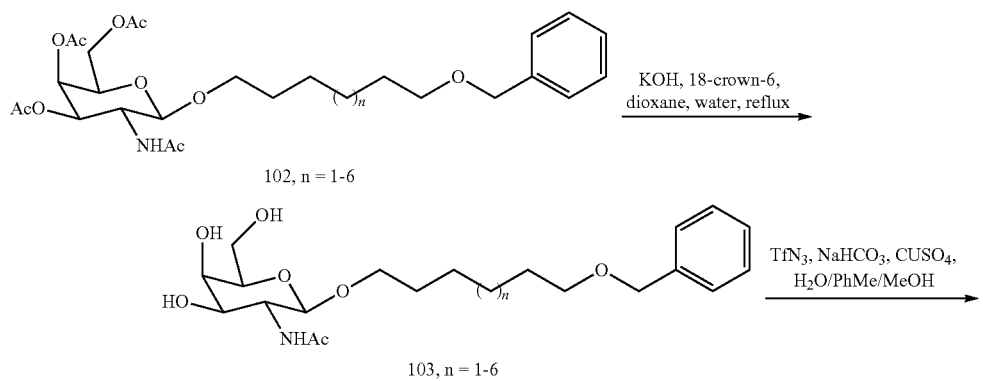

-continued

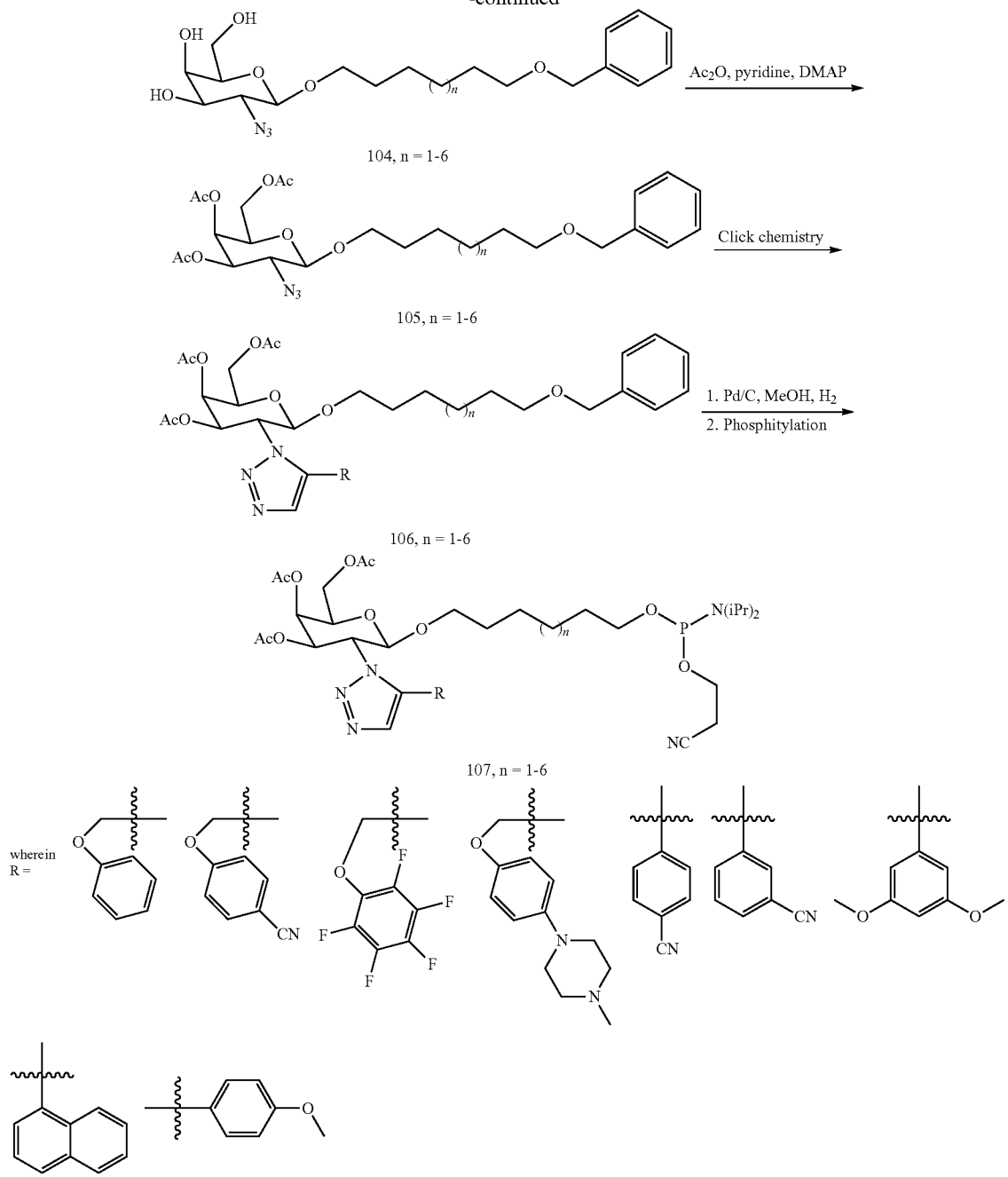

Using the method shown in the scheme above, a variety of GalNAc moieties modified to comprise a triazole at the C2 position can be prepared, represented by compound 107. Phosphoramidite 107 can be conjugated to the 5'-end of an oligonucleotide of any sequence using an automated oligonucleotide synthesizer, resulting in a variety of oligonucleotides. Alternatively, the pentafluorophenyl ester of deprotected compound 106 can be synthesized and conjugated to an oligonucleotide of any sequence, resulting in a variety of oligonucleotides.

Example 17: Dose-Dependent Antisense Inhibition of Human ApoC III in huApoC III Transgenic Mice ISIS 304801 and ISIS 647535, each targeting human ApoC III and described above, were separately tested and evaluated in a dose-dependent study for their ability to inhibit human ApoC III in human ApoC III transgenic mice.

Treatment

Human ApoCIII transgenic mice were maintained on a 12-hour light/dark cycle and fed ad libitum Teklad lab chow. Animals were acclimated for at least 7 days in the research facility before initiation of the experiment. ASOs were prepared in PBS and sterilized by filtering through a 0.2 micron filter. ASOs were dissolved in 0.9% PBS for injection.

Human ApoC III transgenic mice were injected intraperitoneally once a week for two weeks with ISIS 304801 or 647535 at 0.08, 0.25. 0.75, 2.25 or 6.75 μmol/kg or with PBS as a control. Each treatment group consisted of 4 animals. Forty-eight hours after the administration of the last dose, blood was drawn from each mouse and the mice were sacrificed and tissues were collected.

ApoC III mRNA Analysis

ApoC III mRNA levels in the mice's livers were determined using real-time PCR and RIBOGREEN® RNA quantification reagent (Molecular Probes, Inc. Eugene, Oreg.) according to standard protocols. ApoC III mRNA levels were determined relative to total RNA (using Ribogreen), prior to normalization to PBS-treated control. The results below are presented as the average percent of ApoC III mRNA levels for each treatment group, normalized to PBS-treated control and are denoted as "% PBS". The half maximal effective dosage ($ED_{50}$) of each ASO is also presented in Table 22, below.

As illustrated, both antisense compounds reduced ApoC III RNA relative to the PBS control. Further, the antisense compound conjugated to $GalNAc_3$-1 (ISIS 647535) was substantially more potent than the antisense compound lacking the $GalNAc_3$-1 conjugate (ISIS 304801).

TABLE 22

Effect of ASO treatment on ApoC III mRNA levels in human ApoC III transgenic mice

| ASO | Dose (μmol/kg) | % PBS | $ED_{50}$ (μmol/kg) | 3' Conjugate | Internucleoside linkage/ Length | SEQ ID No. |
|---|---|---|---|---|---|---|
| PBS | 0 | 100 | — | — | — | |
| ISIS 304801 | 0.08 | 95 | 0.77 | None | PS/20 | 32 |
| | 0.75 | 42 | | | | |
| | 2.25 | 32 | | | | |
| | 6.75 | 19 | | | | |
| ISIS 647535 | 0.08 | 50 | 0.074 | $GalNAc_3$-1 | PS/20 | 111 |
| | 0.75 | 15 | | | | |
| | 2.25 | 17 | | | | |
| | 6.75 | 8 | | | | |

ApoC III Protein Analysis (Turbidometric Assay)

Plasma ApoC III protein analysis was determined using procedures reported by Graham et al, *Circulation Research*, published online before print Mar. 29, 2013. Approximately 100 μl of plasma isolated from mice was analyzed without dilution using an Olympus Clinical Analyzer and a commercially available turbidometric ApoC III assay (Kamiya, Cat # KAI-006, Kamiya Biomedical, Seattle, Wash.). The assay protocol was performed as described by the vendor.

As shown in the Table 23 below, both antisense compounds reduced ApoC III protein relative to the PBS control. Further, the antisense compound conjugated to $GalNAc_3$-1 (ISIS 647535) was substantially more potent than the antisense compound lacking the $GalNAc_3$-1 conjugate (ISIS 304801).

TABLE 23

Effect of ASO treatment on ApoC III plasma protein levels in human ApoC III transgenic mice

| ASO | Dose (μmol/kg) | % PBS | $ED_{50}$ (μmol/kg) | 3' Conjugate | Internucleoside Linkage/ Length | SEQ ID No. |
|---|---|---|---|---|---|---|
| PBS | 0 | 100 | — | — | — | |
| ISIS 304801 | 0.08 | 86 | 0.73 | None | PS/20 | 32 |
| | 0.75 | 51 | | | | |
| | 2.25 | 23 | | | | |
| | 6.75 | 13 | | | | |
| ISIS 647535 | 0.08 | 72 | 0.19 | $GalNAc_3$-1 | PS/20 | 111 |
| | 0.75 | 14 | | | | |
| | 2.25 | 12 | | | | |
| | 6.75 | 11 | | | | |

Plasma triglycerides and cholesterol were extracted by the method of Bligh and Dyer (Bligh, E. G. and Dyer, W. J. Can. J. Biochem. Physiol. 37: 911-917, 1959) (Bligh, E and Dyer, W, *Can J Biochem Physiol,* 37, 911-917, 1959)(Bligh, E and Dyer, W, *Can J Biochem Physiol,* 37, 911-917, 1959) and measured by using a Beckmann Coulter clinical analyzer and commercially available reagents.

The triglyceride levels were measured relative to PBS injected mice and are denoted as "% PBS". Results are presented in Table 24. As illustrated, both antisense compounds lowered triglyceride levels. Further, the antisense compound conjugated to $GalNAc_3$-1 (ISIS 647535) was substantially more potent than the antisense compound lacking the $GalNAc_3$-1 conjugate (ISIS 304801).

TABLE 24

Effect of ASO treatment on triglyceride levels in transgenic mice

| ASO | Dose (μmol/kg) | % PBS | $ED_{50}$ (μmol/kg) | 3' Conjugate | Internucleoside Linkage/ Length | SEQ ID No. |
|---|---|---|---|---|---|---|
| PBS | 0 | 100 | — | — | — | |
| ISIS 304801 | 0.08 | 87 | 0.63 | None | PS/20 | 32 |
| | 0.75 | 46 | | | | |
| | 2.25 | 21 | | | | |
| | 6.75 | 12 | | | | |
| ISIS 647535 | 0.08 | 65 | 0.13 | $GalNAc_3$-1 | PS/20 | 111 |
| | 0.75 | 9 | | | | |
| | 2.25 | 8 | | | | |
| | 6.75 | 9 | | | | |

Plasma samples were analyzed by HPLC to determine the amount of total cholesterol and of different fractions of cholesterol (HDL and LDL). Results are presented in Tables 25 and 26. As illustrated, both antisense compounds lowered total cholesterol levels; both lowered LDL; and both raised HDL. Further, the antisense compound conjugated to $GalNAc_3$-1 (ISIS 647535) was substantially more potent than the antisense compound lacking the $GalNAc_3$-1 conjugate (ISIS 304801). An increase in HDL and a decrease in LDL levels is a cardiovascular beneficial effect of antisense inhibition of ApoC III.

TABLE 25

Effect of ASO treatment on total cholesterol levels in transgenic mice

| ASO | Dose (µmol/kg) | Total Cholesterol (mg/dL) | 3' Conjugate | Internucleoside Linkage/Length | SEQ ID No. |
|---|---|---|---|---|---|
| PBS | 0 | 257 | — | — | |
| ISIS 304801 | 0.08 | 226 | None | PS/20 | 32 |
| | 0.75 | 164 | | | |
| | 2.25 | 110 | | | |
| | 6.75 | 82 | | | |
| ISIS 647535 | 0.08 | 230 | GalNAc$_3$-1 | PS/20 | 111 |
| | 0.75 | 82 | | | |
| | 2.25 | 86 | | | |
| | 6.75 | 99 | | | |

TABLE 26

Effect of ASO treatment on HDL and LDL cholesterol levels in transgenic mice

| ASO | Dose (µmol/kg) | HDL (mg/dL) | LDL (mg/dL) | 3' Conjugate | Internucleoside Linkage/Length | SEQ ID No. |
|---|---|---|---|---|---|---|
| PBS | 0 | 17 | 28 | — | — | |
| ISIS 304801 | 0.08 | 17 | 23 | None | PS/20 | 32 |
| | 0.75 | 27 | 12 | | | |
| | 2.25 | 50 | 4 | | | |
| | 6.75 | 45 | 2 | | | |
| ISIS 647535 | 0.08 | 21 | 21 | GalNAc$_3$-1 | PS/20 | 111 |
| | 0.75 | 44 | 2 | | | |
| | 2.25 | 50 | 2 | | | |
| | 6.75 | 58 | 2 | | | |

Pharmacokinetics Analysis (PK)

The PK of the ASOs was also evaluated. Liver and kidney samples were minced and extracted using standard protocols. Samples were analyzed on MSD1 utilizing IP-HPLC-MS. The tissue level (µg/g) of full-length ISIS 304801 and 647535 was measured and the results are provided in Table 27. As illustrated, liver concentrations of total full-length antisense compounds were similar for the two antisense compounds. Thus, even though the GalNAc$_3$-1 conjugated antisense compound is more active in the liver (as demonstrated by the RNA and protein data above), it is not present at substantially higher concentration in the liver. Indeed, the calculated EC$_{50}$ (provided in Table 27) confirms that the observed increase in potency of the conjugated compound cannot be entirely attributed to increased accumulation. This result suggests that the conjugate improved potency by a mechanism other than liver accumulation alone, possibly by improving the productive uptake of the antisense compound into cells.

The results also show that the concentration of GalNAc$_3$-1 conjugated antisense compound in the kidney is lower than that of antisense compound lacking the GalNAc conjugate. This has several beneficial therapeutic implications. For therapeutic indications where activity in the kidney is not sought, exposure to kidney risks kidney toxicity without corresponding benefit. Moreover, high concentration in kidney typically results in loss of compound to the urine resulting in faster clearance. Accordingly, for non-kidney targets, kidney accumulation is undesired. These data suggest that GalNAc$_3$-1 conjugation reduces kidney accumulation.

TABLE 27

PK analysis of ASO treatment in transgenic mice

| ASO | Dose (µmol/kg) | Liver (µg/g) | Kidney (µg/g) | Liver EC$_{50}$ (µg/g) | 3' Conjugate | Internucleoside Linkage/Length | SEQ ID No. |
|---|---|---|---|---|---|---|---|
| ISIS 304801 | 0.1 | 5.2 | 2.1 | 53 | None | PS/20 | 32 |
| | 0.8 | 62.8 | 119.6 | | | | |
| | 2.3 | 142.3 | 191.5 | | | | |
| | 6.8 | 202.3 | 337.7 | | | | |
| ISIS 647535 | 0.1 | 3.8 | 0.7 | 3.8 | GalNAc$_3$-1 | PS/20 | 111 |
| | 0.8 | 72.7 | 34.3 | | | | |
| | 2.3 | 106.8 | 111.4 | | | | |
| | 6.8 | 237.2 | 179.3 | | | | |

Metabolites of ISIS 647535 were also identified and their masses were confirmed by high resolution mass spectrometry analysis. The cleavage sites and structures of the observed metabolites are shown below. The relative % of full length ASO was calculated using standard procedures and the results are presented in Table 28. The major metabolite of ISIS 647535 was full-length ASO lacking the entire conjugate (i.e. ISIS 304801), which results from cleavage at cleavage site A, shown below. Further, additional metabolites resulting from other cleavage sites were also observed. These results suggest that introducing other cleabable bonds such as esters, peptides, disulfides, phosphoramidates or acyl-hydrazones between the GalNAc$_3$-1 sugar and the ASO, which can be cleaved by enzymes inside the cell, or which may cleave in the reductive environment of the cytosol, or which are labile to the acidic pH inside endosomes and lyzosomes, can also be useful.

TABLE 28

Observed full length metabolites of ISIS 647535

| Metabolite | ASO | Cleavage site | Relative % |
|---|---|---|---|
| 1 | ISIS 304801 | A | 36.1 |
| 2 | ISIS 304801 + dA | B | 10.5 |
| 3 | ISIS 647535 minus [3 GalNAc] | C | 16.1 |
| 4 | ISIS 647535 minus [3 GalNAc + 1 5-hydroxy-pentanoic acid tether] | D | 17.6 |
| 5 | ISIS 647535 minus [2 GalNAc + 2 5-hydroxy-pentanoic acid tether] | D | 9.9 |
| 6 | ISIS 647535 minus [3 GalNAc + 3 5-hydroxy-pentanoic acid tether] | D | 9.8 |

Cleavage Sites
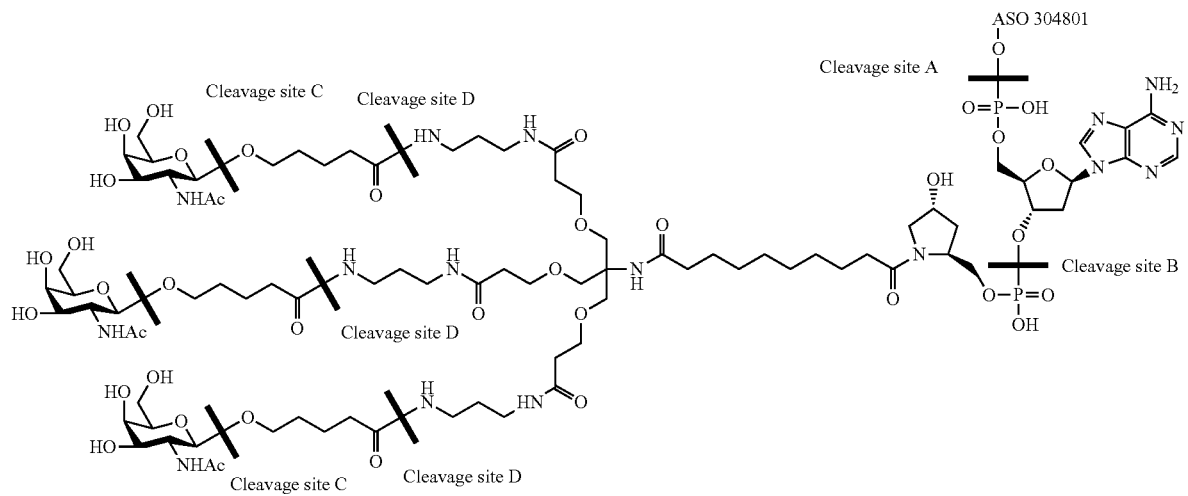
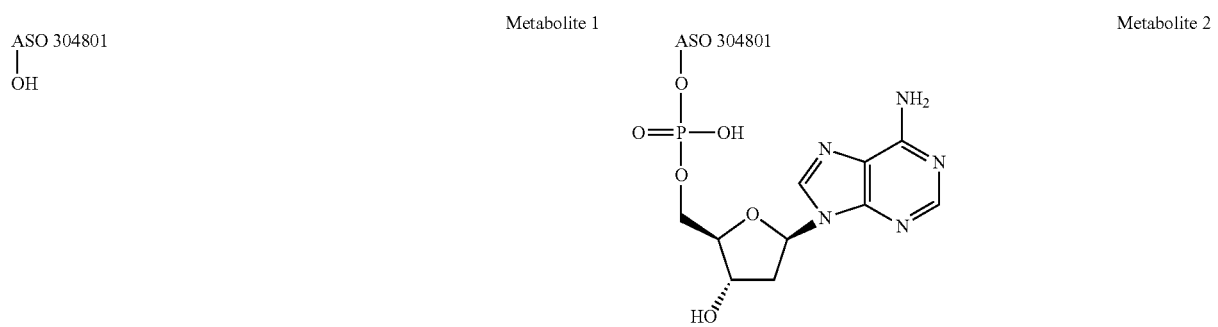
Metabolite 1  Metabolite 2
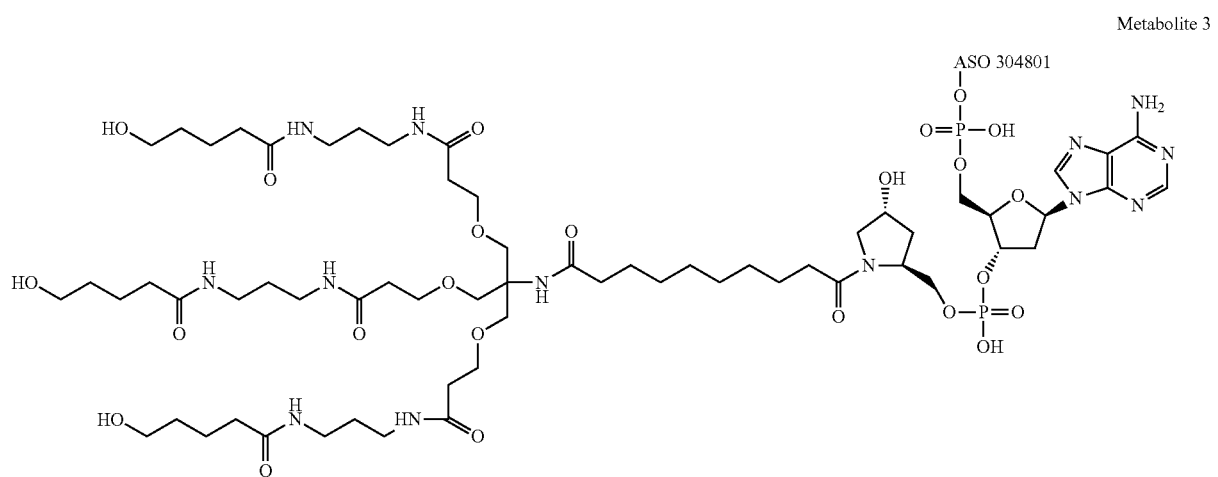
Metabolite 3

Metabolite 4

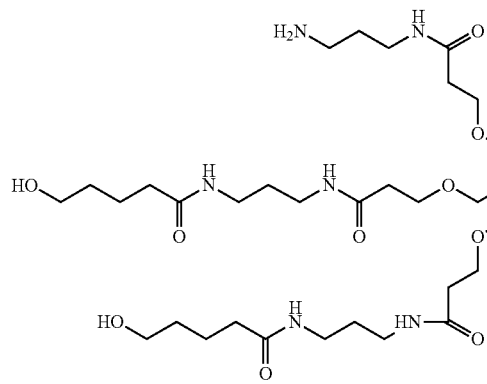
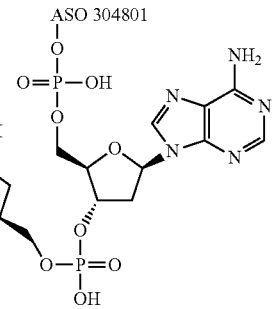

Metabolite 5

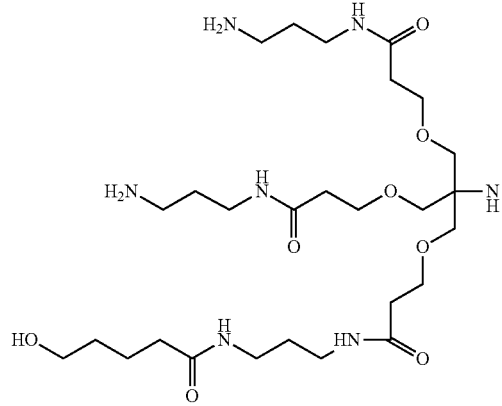
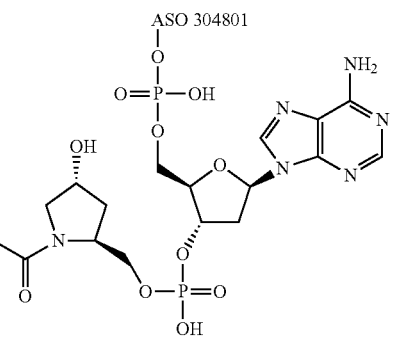

Metabolite 6

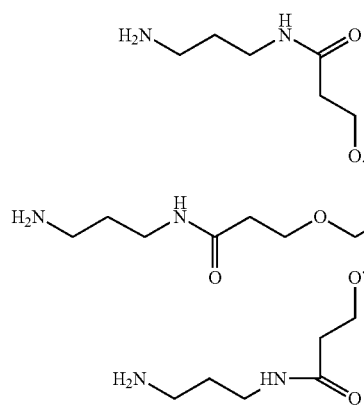
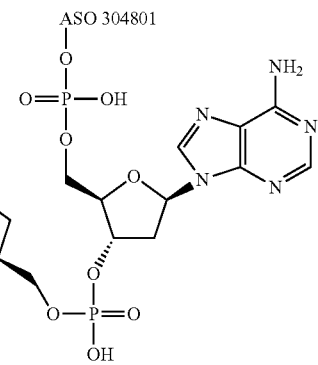

Example 18: Dose-Dependent Study of Phosphodiester Linked GalNAc$_3$-7$_a$, β-Thio-GalNAc$_3$-7$_a$ and MP-Triazole-GalNAc$_3$-7$_a$ at the 5' Terminus Targeting SRB-1 In Vivo The conjugated oligonucleotides listed below were tested in a dose-dependent study for antisense inhibition of SRB-1 in mice. The unconjugated parent oligonucleotide ISIS 353382 was included in the study for comparison. The study compared the effect of GalNAc$_3$-7$_a$ and two sugar modified GalNAc$_3$-7$_a$ conjugate groups (β-thio-GalNAc$_3$-7$_a$, also referred to herein as GalNAc$_3$-35$_a$, structure shown in compound 30 in Example 4; and MP-Triazole-GalNAc$_3$-7$_a$, also referred to herein as GalNAc$_3$-33$_a$ (structure shown in compound 63 where n=6 in Example 8) wherein each of the sugar modified oligonucleotides were tested with and without a deoxyadenosine (A$_d$) cleavable moiety.

| ISIS #/Seq Id No. | Sequence 5'-3' |
|---|---|
| 353382/142 | $G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T_e$ |
| 666981/141 | <u>GalNAc3-7a$_o$</u>,A$_{do}$G$_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}$ T$_{ds}$T$_{es}{}^mC_{es}{}^mC_{es}T_{es}T_e$ |
| 709049/141 | <u>β-thio-GalNAc$_3$-7$_{aO}$</u>,A$_{do}$G$_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}$ T$_{ds}$T$_{es}{}^mC_{es}{}^mC_{es}T_{es}T_e$ |
| 720810/142 | <u>β-thio-GalNAc$_3$-7$_{aO}$</u>,G$_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}$ T$_{es}$T$_e$ |
| 721455/141 | <u>C6-MP-Triazole-GalNAc$_3$-7$_{aO}$</u>,A$_{do}$G$_{es}{}^mC_{es}T_{es}T_{es}{}^mC_{es}A_{ds}G_{ds}T_{ds}{}^mC_{ds}A_{ds}T_{ds}G_{ds}A_{ds}$ $^mC_{ds}T_{ds}T_{es}{}^mC_{es}{}^mC_{es}T_{es}T_e$ |
| 721456/142 | <u>C6-MP-Triazole-GalNAc$_3$-7$_{aO}$</u>,G$_{es}{}^mC_{es}T_{es}T_{es}{}^mC_{es}A_{ds}G_{ds}T_{ds}{}^mC_{ds}A_{ds}T_{ds}G_{ds}A_{ds}$ $^mC_{ds}T_{ds}T_{es}{}^mC_{es}{}^mC_{es}T_{es}T_e$ |

Capital letters indicate the nucleobase for each nucleoside and $^mC$ indicates a 5-methyl cytosine. Subscripts: "e" indicates a 2'-O—(CH$_2$)$_3$—OCH$_3$ (MOE) modified nucleoside; "d" indicates a β-D-2'-deoxyribonucleoside; "s" indicates a phosphorothioate internucleoside linkage (PS); "o" indicates a phosphodiester internucleoside linkage (PO); and "o" indicates —O—P(=O)(OH)—. Conjugate groups are underlined.

Treatment

Six week old male Balb/c mice (Jackson Laboratory, Bar Harbor, Me.) were injected subcutaneously once at the dosage shown below with ISIS 353382, 666981, 709049, 720810, 721455, 721456 or with PBS treated control. Each treatment group consisted of 4 animals. The mice were sacrificed 72 hours following administration to determine the liver SRB-1 mRNA levels using real-time PCR and RIBOGREEN® RNA quantification reagent (Molecular Probes, Inc. Eugene, Oreg.) according to standard protocols. SRB-1 mRNA levels were determined relative to total RNA (using Ribogreen), prior to normalization to PBS-treated control. The results below are presented as the average percent of SRB-1 mRNA levels for each treatment group, normalized to PBS-treated control and is denoted as "% PBS". The ED$_{50}$s were measured using similar methods as described previously and are presented below. The ED$_{50}$s listed in Table 29 below were calculated by plotting the concentrations of oligonucleotides used versus the percent inhibition of SRB-1 mRNA expression achieved at each concentration, and noting the concentration of oligonucleotide at which 50% inhibition of SRB-1 mRNA expression was achieved compared to the control.

TABLE 29

ASOs containing GalNAc$_3$-7 w/wo modified sugars targeting SRB-1

| ISIS No. | Dosage (mg/kg) | SRB-1 mRNA levels (% PBS) | ED$_{50}$ mg/kg | 5'-Conjugate | SEQ ID No. |
|---|---|---|---|---|---|
| PBS | 0 | 100 | — | — | — |
| 353382 | 3 | 107 | 27.2 | No conjugate | 142 |
|  | 10 | 80 |  |  |  |
|  | 30 | 48 |  |  |  |
| 666981 | 0.5 | 99 | 3.4 | GalNAc$_3$-7a with dA | 141 |
|  | 1.5 | 71 |  |  |  |
|  | 5 | 35 |  |  |  |
|  | 15 | 21 |  |  |  |
| 709049 | 0.5 | 87 | 3.1 | β-thio GalNAc$_3$-7a with dA | 141 |
|  | 1.5 | 66 |  |  |  |
|  | 5 | 38 |  |  |  |
|  | 15 | 18 |  |  |  |
| 720810 | 0.5 | 80 | 3.3 | β-thio GalNAc$_3$-7a without dA | 142 |
|  | 1.5 | 66 |  |  |  |
|  | 5 | 43 |  |  |  |
|  | 15 | 19 |  |  |  |
| 721455 | 0.5 | 90 | 4.7 | MP-Triazole GalNAc$_3$-7a with dA | 141 |
|  | 1.5 | 72 |  |  |  |
|  | 5 | 47 |  |  |  |
|  | 15 | 29 |  |  |  |
| 721456 | 0.5 | 85 | 3.7 | MP-Triazole GalNAc$_3$-7a without dA | 142 |
|  | 1.5 | 64 |  |  |  |
|  | 5 | 44 |  |  |  |
|  | 15 | 27 |  |  |  |

As illustrated in Table 29, treatment with antisense oligonucleotides lowered SRB-1 mRNA levels in a dose-dependent manner. Indeed, the antisense oligonucleotides comprising the phosphodiester linked conjugate groups showed substantial improvement in potency compared to the unconjugated antisense oligonucleotide (ISIS 353382).

The results of the body weights, liver transaminases, total bilirubin, and BUN measurements were all essentially unaffected by the oligonucleotides tested, indicating that the oligonucleotides were well tolerated.

Example 19: Dose-Dependent Study of 5' Phosphodiester Linked GalNAc$_3$-7$_a$, GalNAc$_1$-25$_a$, GalNAc$_1$-34$_a$, and α-Thio-GalNAc$_3$-7 Targeting SRB-1 In Vivo The conjugated oligonucleotides listed below were tested in a dose-dependent study for antisense inhibition of SRB-1 in mice. The unconjugated parent oligonucleotide ISIS 353382 was included in the study for comparison. The study included a comparison of the effect of GalNAc$_3$-7$_a$, GalNAc$_1$-25$_a$ and GalNAc$_1$-34$_a$ (structure shown in compound 68a wherein n=6 in Example 9). These conjugate groups were attached directly to the parent antisense oligonucleotide without an $A_d$ cleavable moiety. The study also included a comparison of the effect of $GalNAc_3\text{-}7_a$ and α-thio-$GalNAc_3\text{-}7_a$ (also referred to herein as $GalNAc_3\text{-}36_a$, structure shown in compound 35 in Example 5). These conjugate groups were attached to the parent antisense oligonucleotide with an $A_d$ cleavable moiety.

Modified ASOs Targeting SRB-1

| ISIS #/Seq Id No. | Sequence 5'-3' |
|---|---|
| 353382/142 | $G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T_e$ |
| 702489/142 | $\underline{GalNAc_3\text{-}7_{aO}},G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T_e$ |
| 711462/142 | $\underline{GalNAc_1\text{-}25_{aO}},G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T$ |
| 727852/142 | $\underline{GalNAc_1\text{-}34_{aO}},G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T$ |
| 666981/141 | $\underline{GalNAc_3\text{-}7_{aO}},A_{do}G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T_e$ |
| 720333/141 | $\underline{\alpha\text{-thio-}GalNAc_3\text{-}7_{aO}},A_{do}G_{es}{}^mC_{es}T_{es}T_{es}{}^mC_{es}A_{ds}G_{ds}T_{ds}{}^mC_{ds}A_{ds}T_{ds}G_{ds}A_{ds}{}^mC_{ds}T_{ds}T_{es}{}^mC_{es}{}^mC_{es}T_{es}T_e$ |

Capital letters indicate the nucleobase for each nucleoside and $^mC$ indicates a 5-methyl cytosine. Subscripts: "e" indicates a 2'-O—$(CH_2)_3$—$OCH_3$ (MOE) modified nucleoside; "d" indicates a β-D-2'-deoxyribonucleoside; "s" indicates a phosphorothioate internucleoside linkage (PS); "o" indicates a phosphodiester internucleoside linkage (PO); and "o" indicates —O—P(=O)(OH)—. Conjugate groups are underlined.

Treatment

Six week old male Balb/c mice (Jackson Laboratory, Bar Harbor, Me.) were injected subcutaneously with the ASOs listed below twice a week for 3 weeks at the dosage shown or with PBS. Each treatment group consisted of 4 animals. The mice were sacrificed 72 hours following administration to determine the liver SRB-1 mRNA levels using real-time PCR and RIBOGREEN® RNA quantification reagent (Molecular Probes, Inc. Eugene, Oreg.) according to standard protocols. SRB-1 mRNA levels were determined relative to total RNA (using RIBOGREEN®), prior to normalization to PBS-treated control. The results below are presented as the average percent of SRB-1 mRNA levels for each treatment group. The data was normalized to PBS-treated control and is denoted as "% PBS". The $ED_{50}$s listed in Table 30 were calculated by plotting the concentrations of oligonucleotides used versus the percent inhibition of SRB-1 mRNA expression achieved at each concentration, and noting the concentration of oligonucleotide at which 50% inhibition of SRB-1 mRNA expression was achieved compared to the control.

TABLE 30

ASOs containing mod/unmod $GalNAc_3\text{-}7_a$/$GalNAc_1\text{-}25_a$ targeting SRB-1

| ISIS No. | Dosage (mg/kg) | SRB-1 mRNA levels (% PBS) | $ED_{50}$ mg/kg | 5'-Conjugate | SEQ ID No. |
|---|---|---|---|---|---|
| PBS | 0 | 100 | — | — | — |
| 353382 | 3 | 72 | 20.7 | No conjugate | 142 |
|  | 10 | 62 |  |  |  |
|  | 30 | 36 |  |  |  |
| 666981 | 0.5 | 73 | 2.3 | $GalNAc_3\text{-}7_a$ with dA | 141 |
|  | 1.5 | 55 |  |  |  |
|  | 5 | 26 |  |  |  |
|  | 15 | 15 |  |  |  |
| 720333 | 0.5 | 82 | 3.1 | α-thio $GalNAc_3\text{-}7_a$ | 141 |
|  | 1.5 | 52 |  |  |  |
|  | 5 | 31 |  |  | with dA |
|  | 15 | 20 |  |  |  |
| 702489 | 0.5 | 79 | 2.4 | $GalNAc_3\text{-}7_a$ without dA | 142 |
|  | 1.5 | 65 |  |  |  |
|  | 5 | 23 |  |  |  |
|  | 15 | 10 |  |  |  |
| 711462 | 0.5 | 89 | 4.9 | $GalNAc_1\text{-}25_a$ without dA | 142 |
|  | 1.5 | 75 |  |  |  |
|  | 5 | 36 |  |  |  |
|  | 15 | 25 |  |  |  |
| 727852 | 0.5 | 99 | 2.9 | $GalNAc_1\text{-}34_a$ without dA | 142 |
|  | 1.5 | 70 |  |  |  |
|  | 5 | 30 |  |  |  |
|  | 15 | 10 |  |  |  |

As illustrated in Table 30, treatment with antisense oligonucleotides lowered SRB-1 mRNA levels in a dose-dependent manner. Indeed, the antisense oligonucleotides comprising the phosphodiester linked conjugate groups showed substantial improvement in potency compared to the unconjugated antisense oligonucleotide (ISIS 353382). It was unexpected that ISIS 727852 having a single modified GalNAc sugar provided equivalent activity compared to ISIS 702489 which comprises 3 unmodified GalNAc sugars.

The results of the body weights, liver transaminases, total bilirubin, and BUN measurements were all essentially unaffected by the oligonucleotides tested, indicating that the oligonucleotides were well tolerated.

Example 20: Dose-Dependent Study of Modified ASOs Targeting APOC-III In Vivo

The compounds in the table below were designed to target mouse APOC-III.

TABLE 31

Modified ASOs targeting mouse APOC-III

| Isis No. | Sequence | SEQ ID NO. |
|---|---|---|
| 440670 | $^mC_{es} A_{es} G_{es} {}^mC_{es} T_{es} T_{ds} T_{ds} A_{ds} T_{ds} T_{ds} A_{ds} G_{ds} G_{ds} G_{ds} A_{ds} {}^mC_{es} A_{es} G_{es} {}^mC_{es} A_e$ | 143 |
| 680772 | $\text{GalNAC}_3\text{-}7_{a\text{-}o}, {}^mC_{es} A_{es} G_{es} {}^mC_{es} T_{es} T_{ds} T_{ds} A_{ds} T_{ds} T_{ds} A_{ds} G_{ds} G_{ds} G_{ds} A_{ds} {}^mC_{es} A_{es}$ $\underline{G_{es} {}^mC_{es} A_e}$ | 143 |
| 742119 | $\text{GalNAC}_1\text{-}37_{a\text{-}o}, {}^mC_{es} A_{es} G_{es} {}^mC_{es} T_{es} T_{ds} T_{ds} A_{ds} T_{ds} T_{ds} A_{ds} G_{ds} G_{ds} G_{ds} A_{ds} {}^mC_{es}$ $\underline{A_{es} G_{es} {}^mC_{es} A_e}$ | 143 |
| 742117 | $\text{GalNAC}_1\text{-}34_{a\text{-}o}, {}^mC_{es} A_{es} G_{es} {}^mC_{es} T_{es} T_{ds} T_{ds} A_{ds} T_{ds} T_{ds} A_{ds} G_{ds} G_{ds} G_{ds} A_{ds} {}^mC_{es}$ $\underline{A_{es} G_{es} {}^mC_{es} A_e}$ | 143 |
| 696846 | $\text{GalNAC}_3\text{-}7_{a\text{-}o}, {}^mC_{es} A_{eo} G_{eo} {}^mC_{eo} T_{eo} T_{ds} T_{ds} A_{ds} T_{ds} T_{ds} A_{ds} G_{ds} G_{ds} G_{ds} A_{ds} {}^mC_{eo}$ $\underline{A_{eo} G_{es} {}^mC_{es} A_e}$ | 143 |
| 742120 | $\text{GalNAC}_1\text{-}37_{a\text{-}o}, {}^mC_{es} A_{eo} G_{eo} {}^mC_{eo} T_{eo} T_{ds} T_{ds} A_{ds} T_{ds} T_{ds} A_{ds} G_{ds} G_{ds} G_{ds} A_{ds} {}^mC_{eo}$ $\underline{A_{eo} G_{es} {}^mC_{es} A_e}$ | 143 |
| 742121 | $\text{GalNAC}_1\text{-}34_{a\text{-}o}, {}^mC_{es} A_{eo} G_{eo} {}^mC_{eo} T_{eo} T_{ds} T_{ds} A_{ds} T_{ds} T_{ds} A_{ds} G_{ds} G_{ds} G_{ds} A_{ds} {}^mC_{eo}$ $\underline{A_{eo} G_{es} {}^mC_{es} A_e}$ | 143 |

The structure of GalNAc$_1$-37$_a$ is shown below:

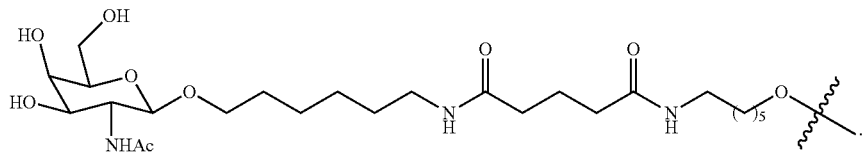

C57/BL6 mice were injected subcutaneously once with the ASOs listed above at the dosage shown or with PBS. Each treatment group consisted of 4 animals. The mice were sacrificed 72 hours following administration to determine the liver APOC-III mRNA levels using real-time PCR and RIBOGREEN® RNA quantification reagent (Molecular Probes, Inc. Eugene, Oreg.) according to standard protocols. APOC-III mRNA levels were determined relative to total RNA (using RIBOGREEN®), prior to normalization to PBS-treated control. The results below are presented as the average percent of APOC-III mRNA levels for each treatment group. The data was normalized to PBS-treated control and is denoted as "% PBS". ED$_{50}$'s were calculated using nonlinear regression. The results below illustrate that the ASOs comprising one, modified GalNAc sugar (GalNAc$_1$-34$_a$) were more potent than the ASOs comprising one, unmodified GalNAc sugar (GalNAc$_1$-37$_a$) and were nearly as potent as the ASOs comprising three, unmodified GalNAc sugars (GalNAc$_3$-7$_a$).

TABLE 32

Activity of modified ASOs targeting mouse APOC-III in vivo

| Isis No. | Dose (mg/kg) | APOC-III mRNA (% PBS) | ED$_{50}$ (mg/kg) | Conjugate group | SEQ ID NO. |
|---|---|---|---|---|---|
| 440670 | 2 | 86 | 25.5 | n/a | 143 |
|  | 6 | 77 |  |  |  |
|  | 20 | 56 |  |  |  |
|  | 60 | 32 |  |  |  |
| 680772 | 0.6 | 77 | 3.1 | GalNAc$_3$-7$_a$ | 143 |
|  | 2 | 64 |  |  |  |
|  | 6 | 32 |  |  |  |
|  | 20 | 19 |  |  |  |
| 742119 | 0.6 | 89 | 5.3 | GalNAc$_1$-37$_a$ | 143 |
|  | 2 | 78 |  |  |  |
|  | 6 | 45 |  |  |  |
|  | 20 | 19 |  |  |  |
| 742117 | 0.6 | 92 | 4.9 | GalNAc$_1$-34$_a$ | 143 |
|  | 2 | 72 |  |  |  |
|  | 6 | 35 |  |  |  |
|  | 20 | 30 |  |  |  |
| 696846 | 0.6 | 77 | 1.3 | GalNAc$_3$-7$_a$ | 143 |
|  | 2 | 28 |  |  |  |
|  | 6 | 17 |  |  |  |
|  | 20 | 12 |  |  |  |
| 742120 | 0.6 | 96 | 6.7 | GalNAc$_1$-37$_a$ | 143 |
|  | 2 | 86 |  |  |  |
|  | 6 | 52 |  |  |  |
|  | 20 | 19 |  |  |  |
| 742121 | 0.6 | 88 | 3.4 | GalNAc$_1$-34$_a$ | 143 |
|  | 2 | 62 |  |  |  |
|  | 6 | 33 |  |  |  |
|  | 20 | 20 |  |  |  |

Example 21: Oligonucleotides Comprising at Least One Modified GalNAc

The following modified GalNAc sugars are conjugate to oligonucleotides. Each oligonucleotide comprises one, two, or three modified GalNAc sugars.

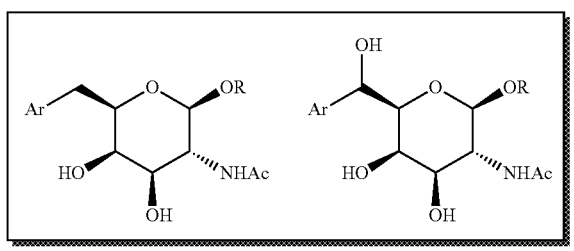
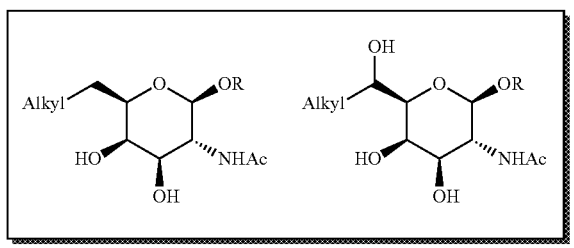
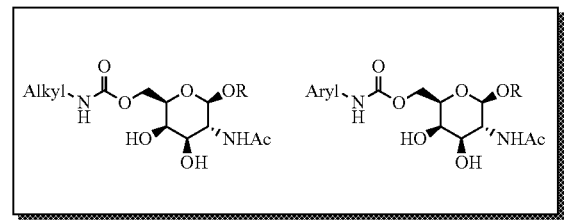
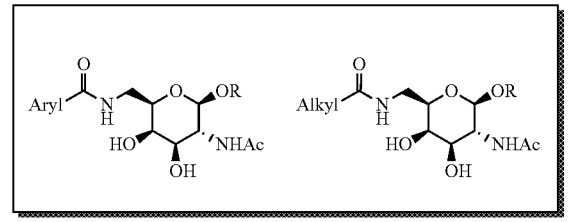
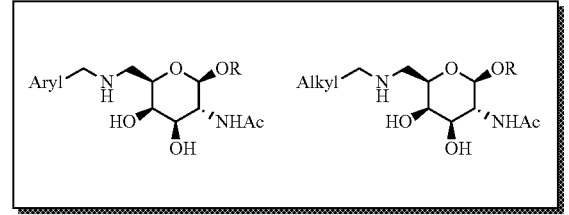
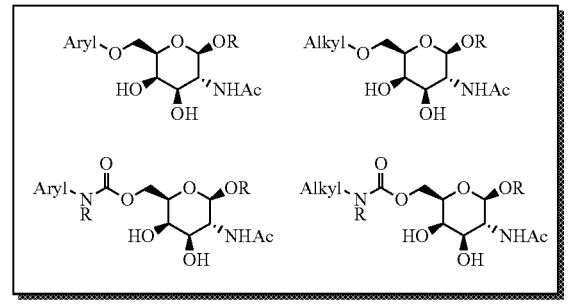
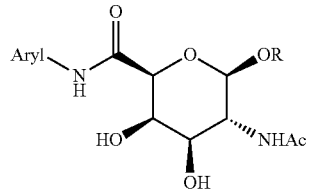
-continued
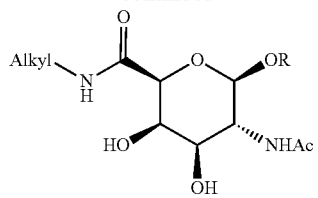
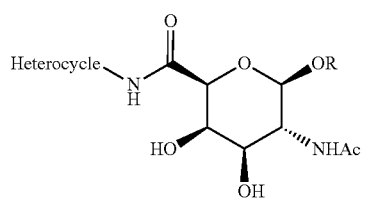
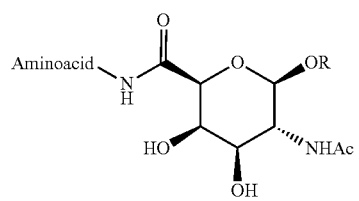
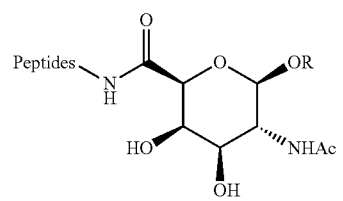
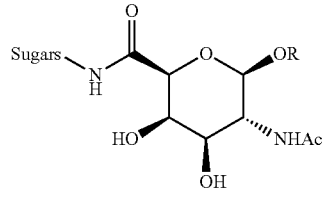
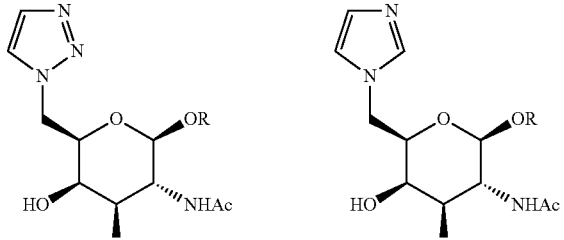
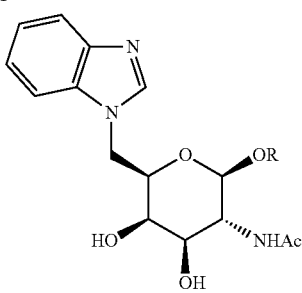

255
-continued
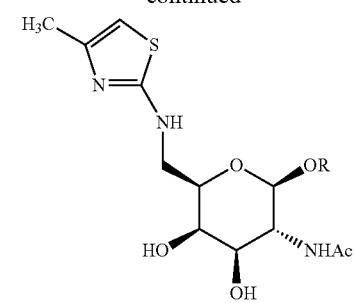
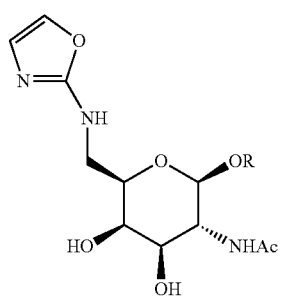
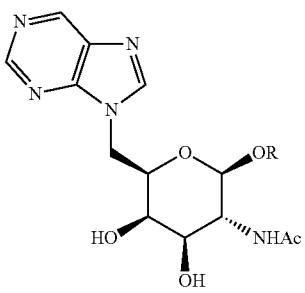
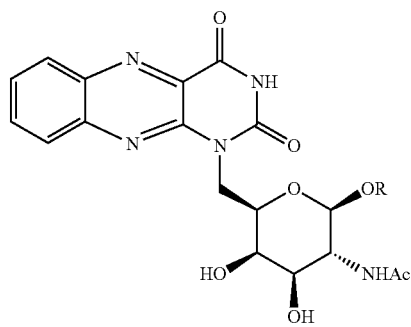
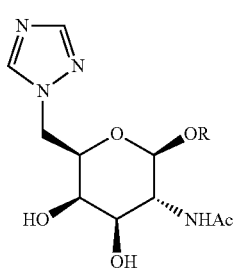
256
-continued
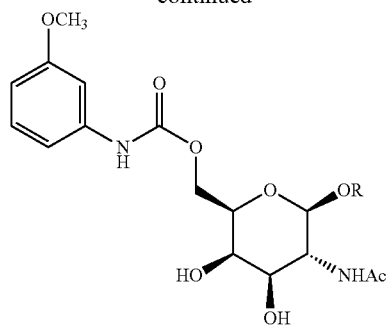
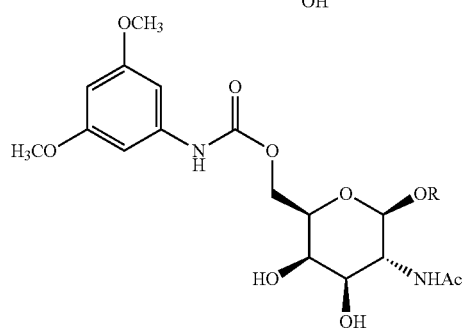
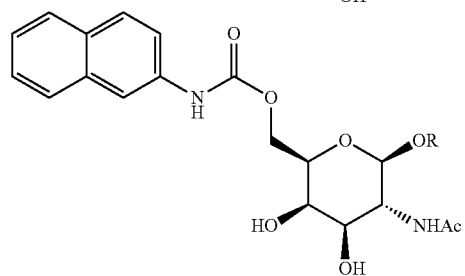
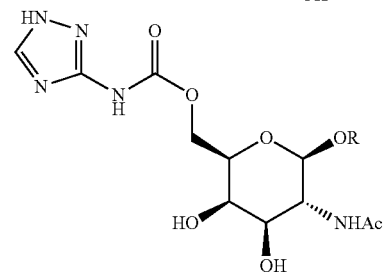
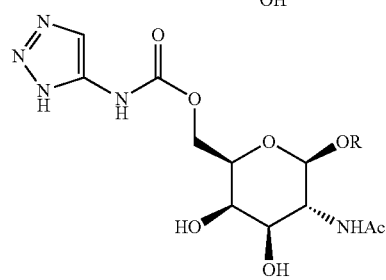
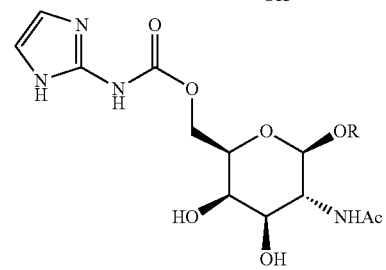

-continued
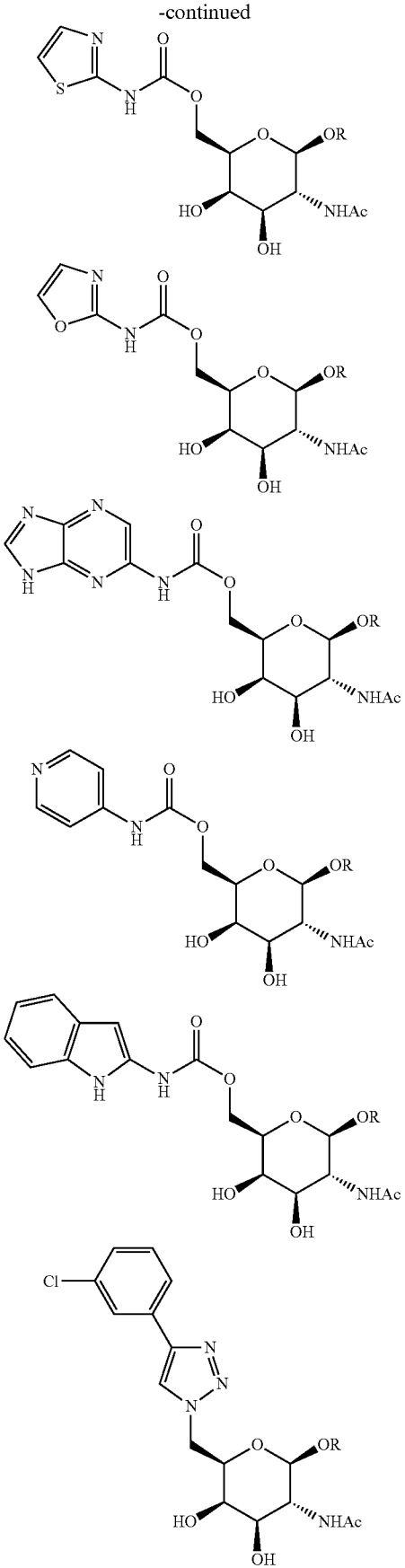
-continued
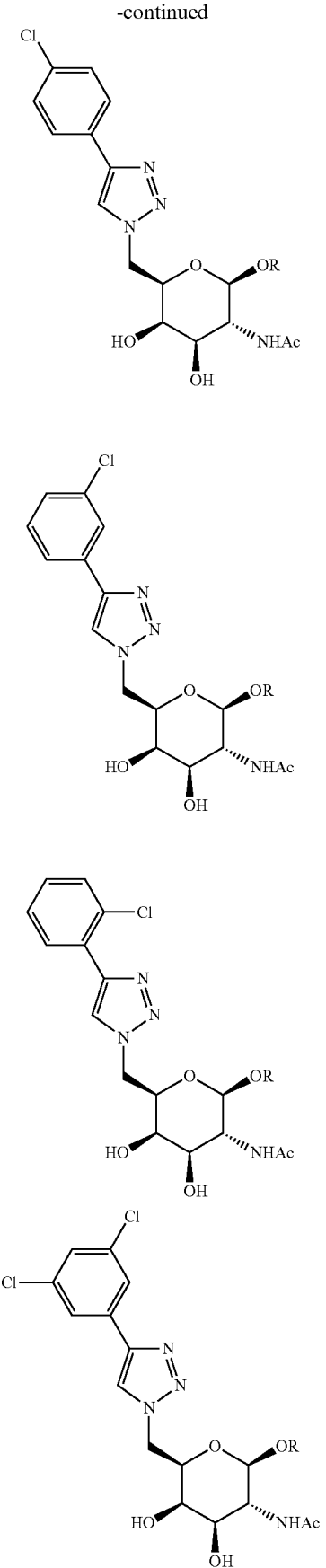

259
-continued
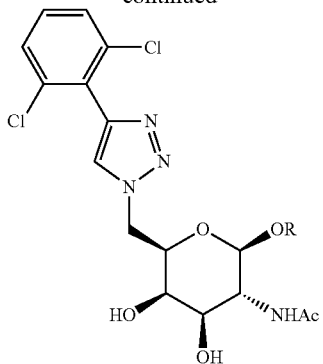
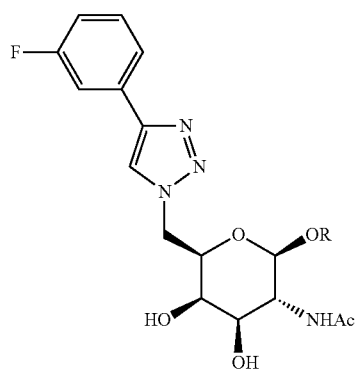
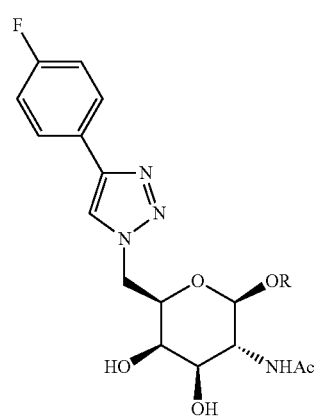
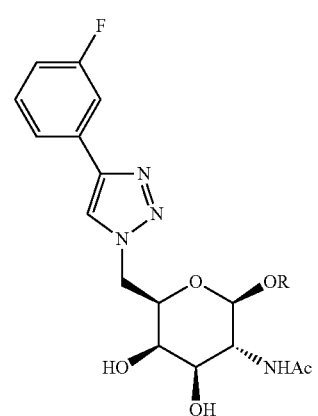
260
-continued
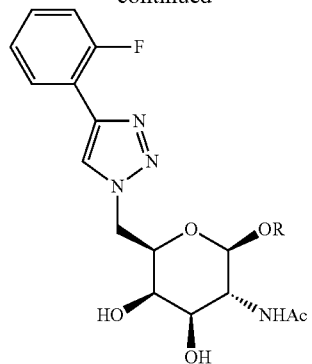
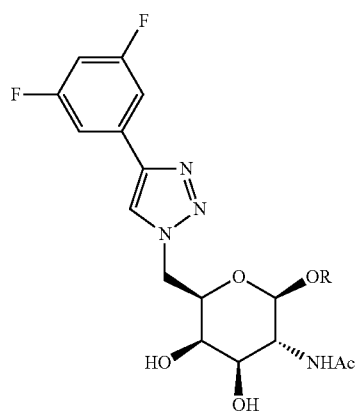
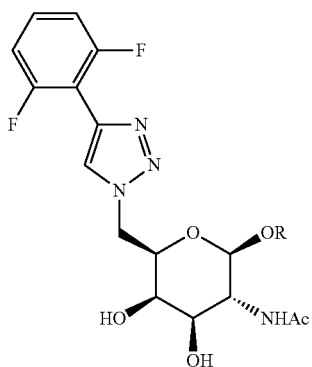
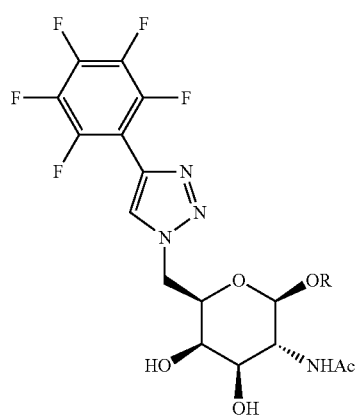

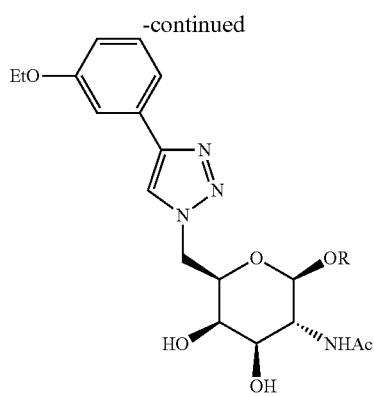
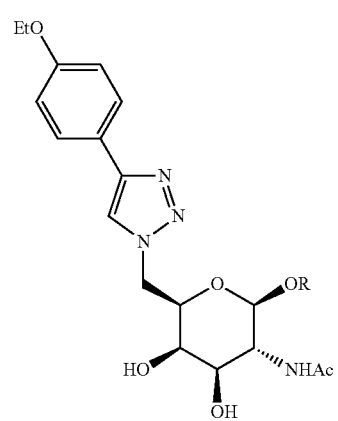
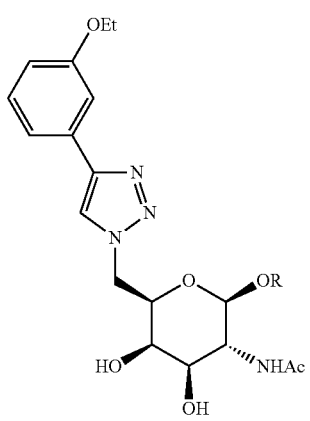
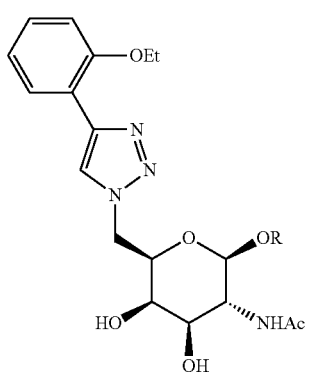
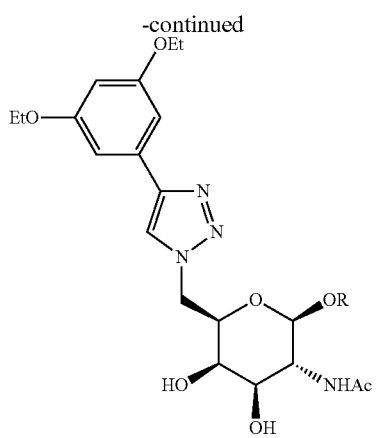
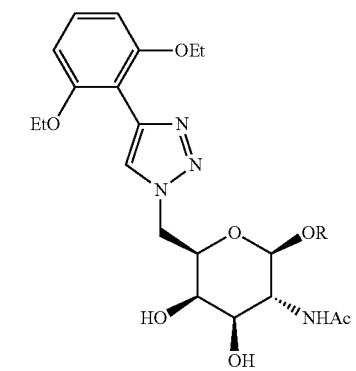
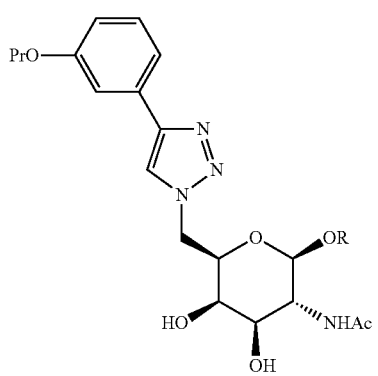
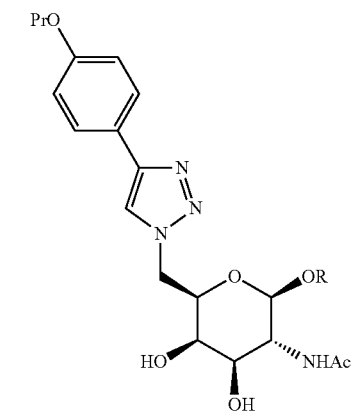

263
-continued
264
-continued
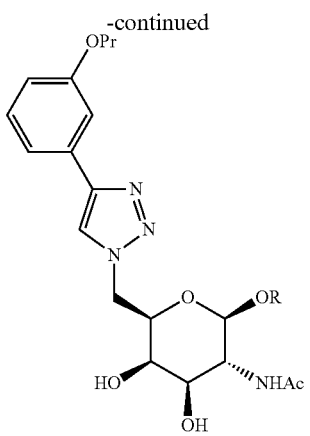
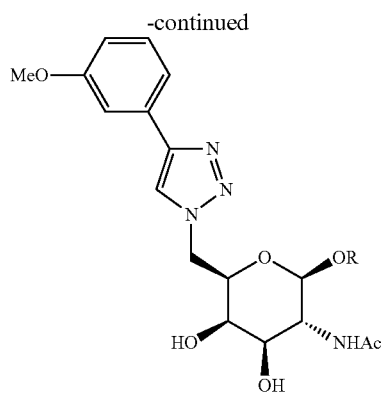
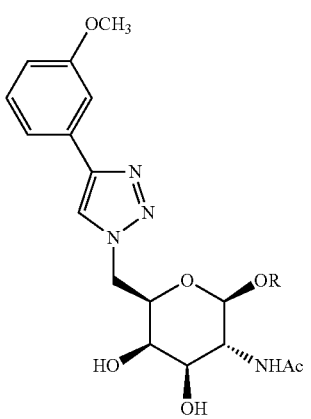
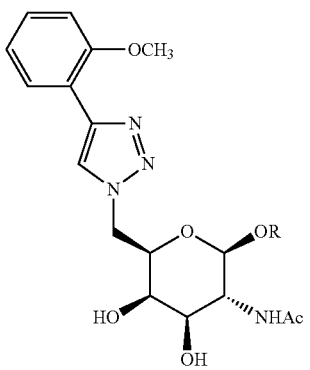

-continued
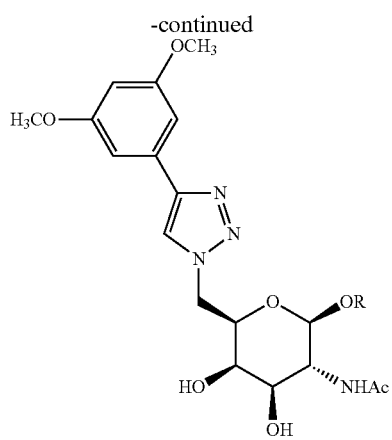
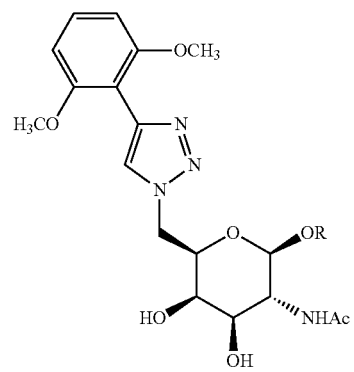
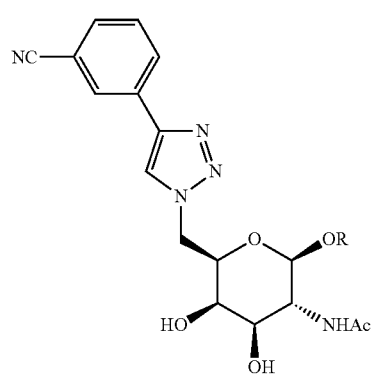
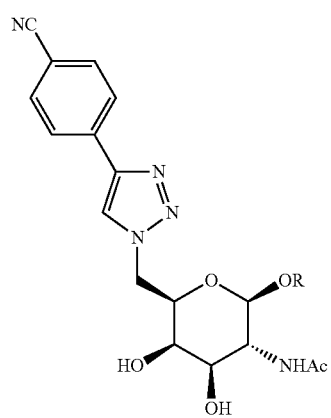
-continued
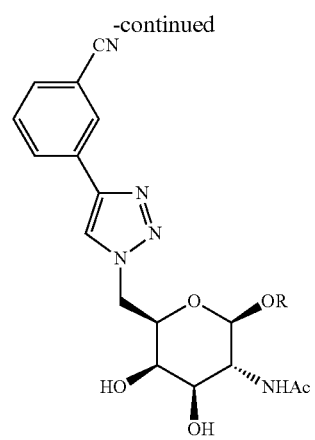
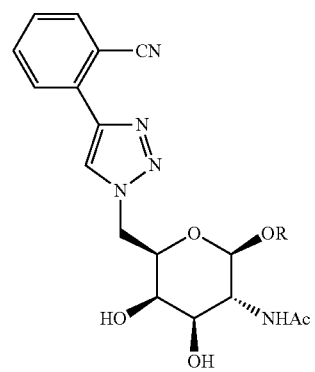
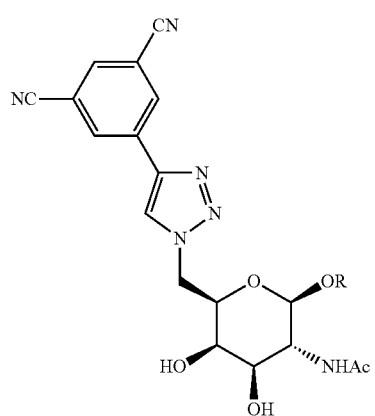
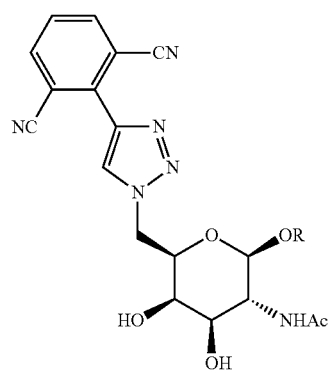

267
-continued
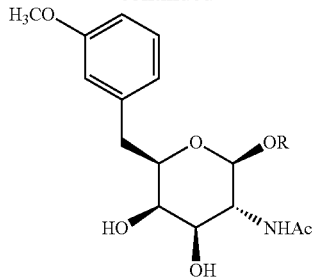
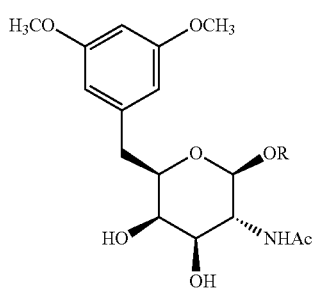
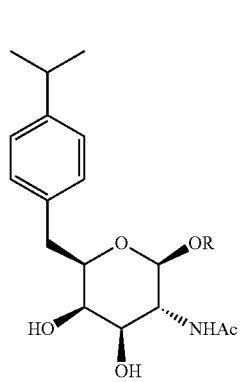 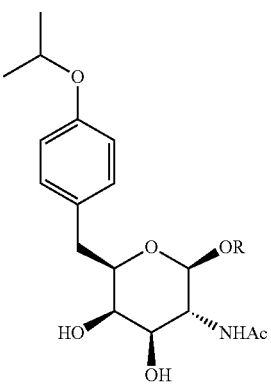
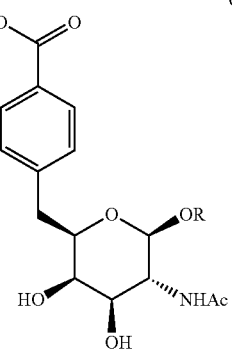
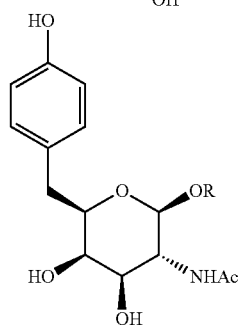
268
-continued
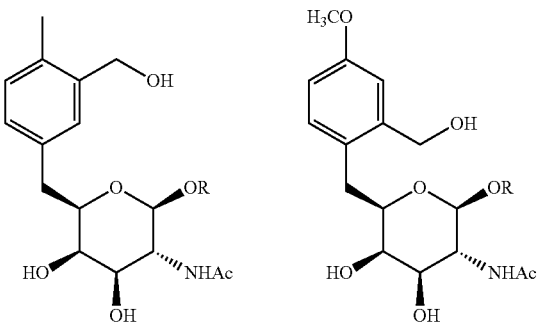
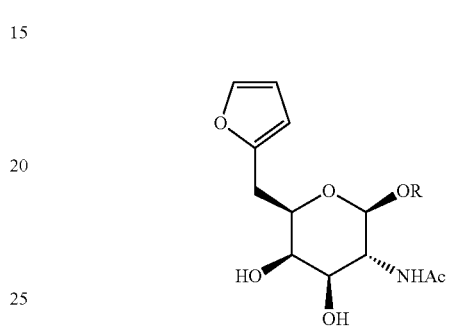
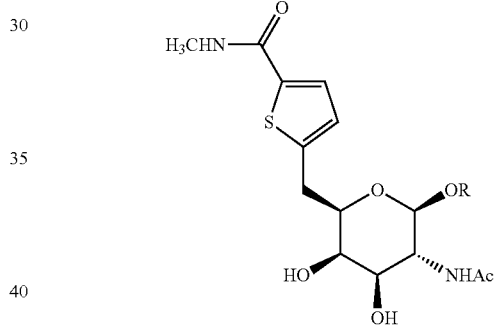
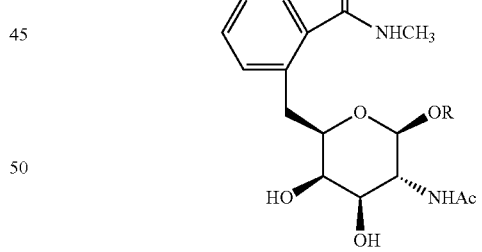
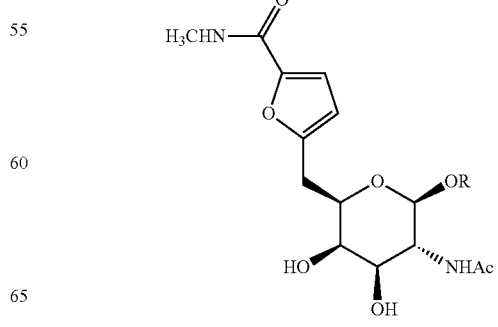

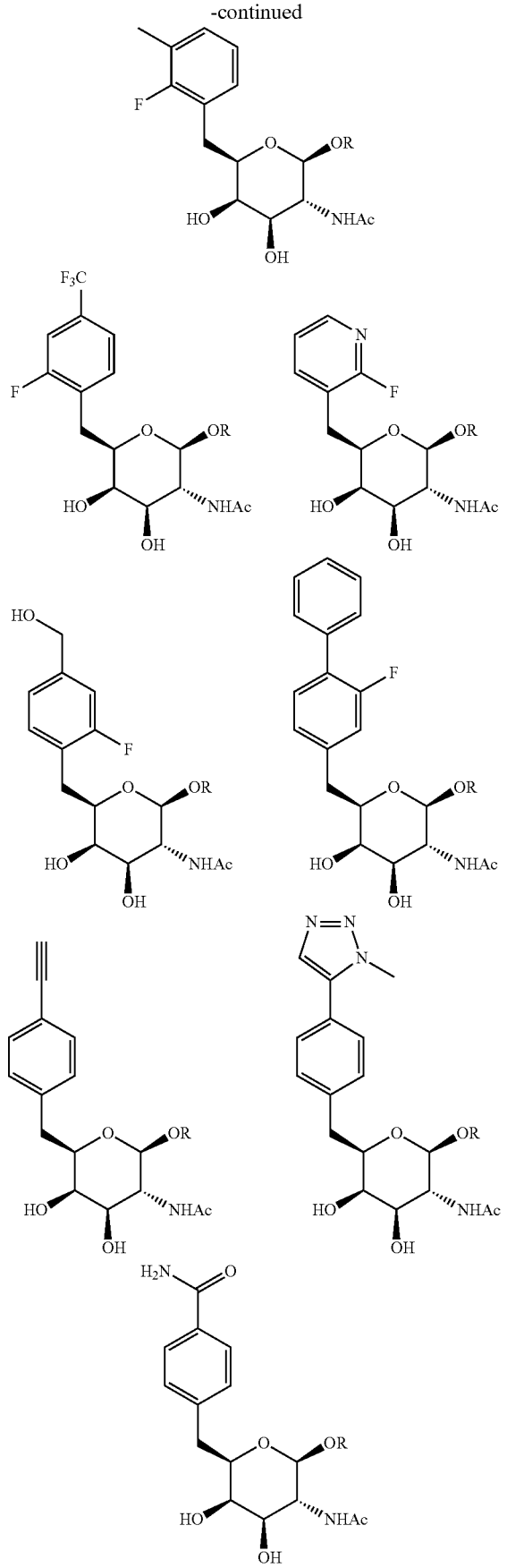

271 272
-continued -continued
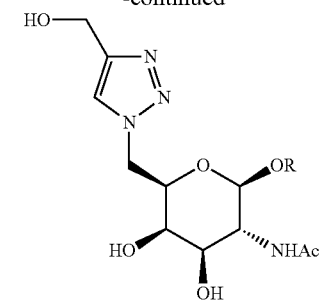
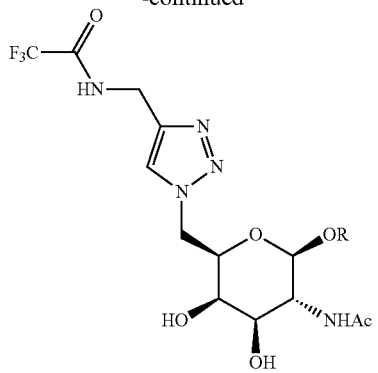
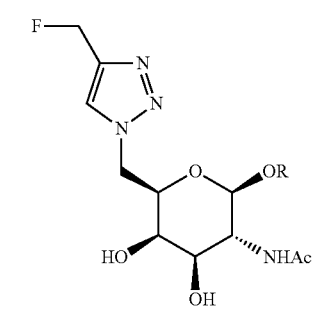
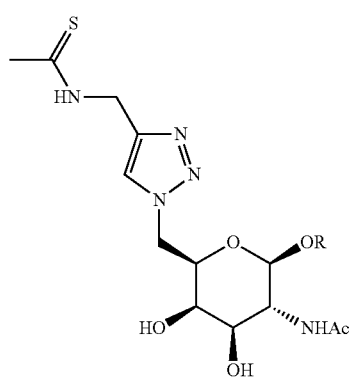
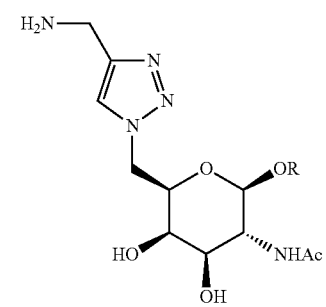
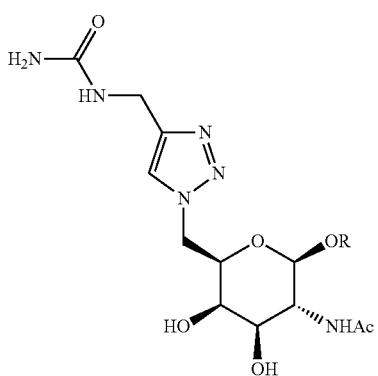
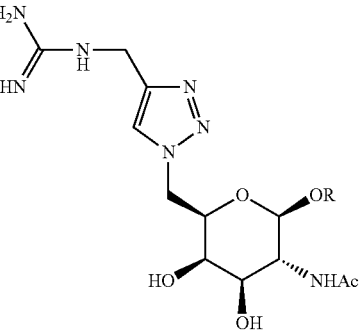
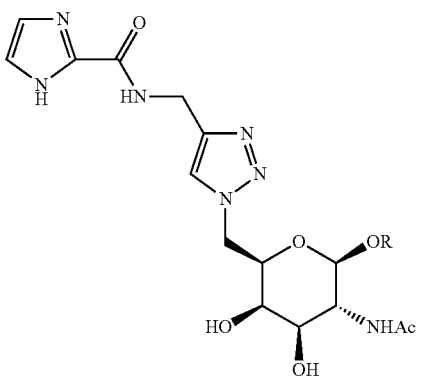
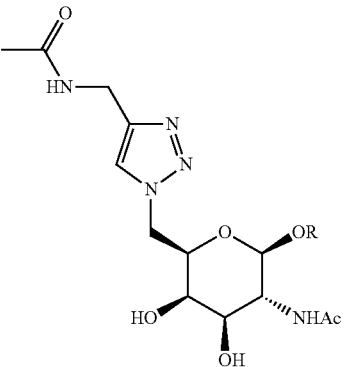

273
-continued
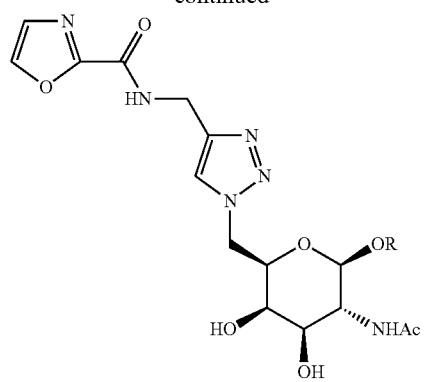
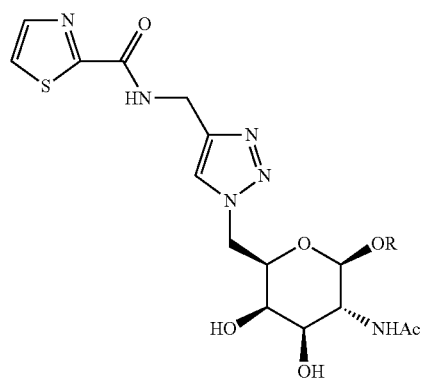
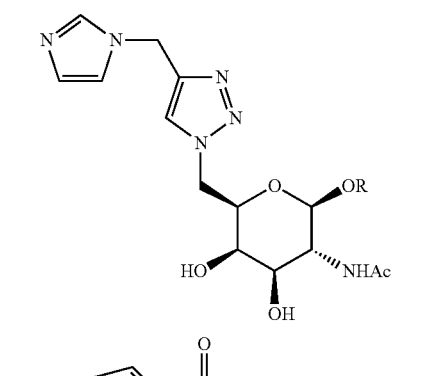
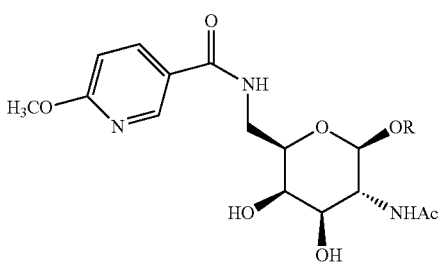
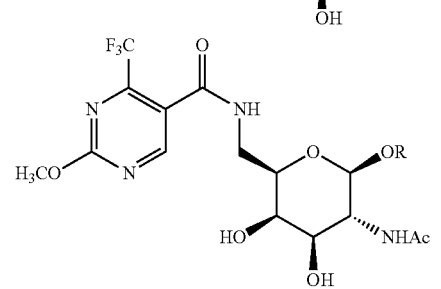
274
-continued
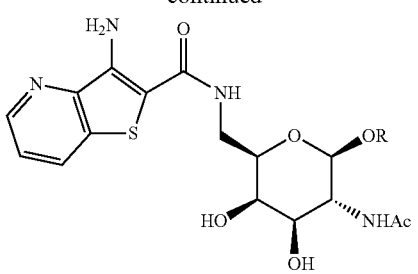
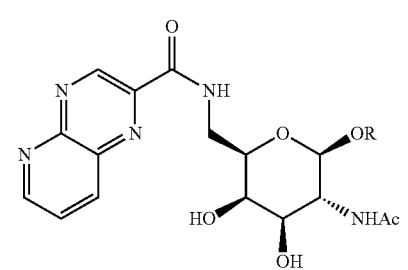
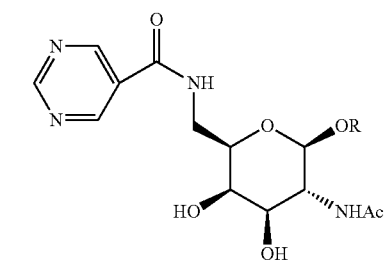
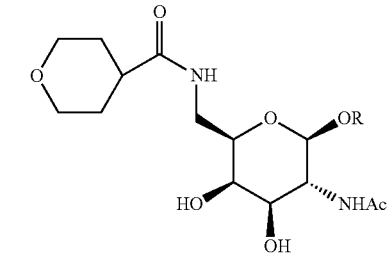
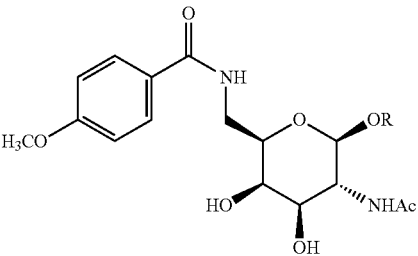
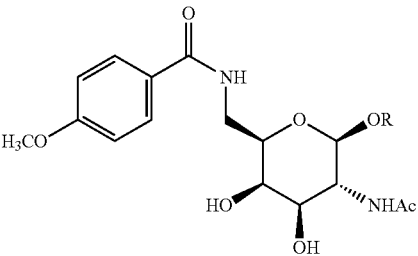

-continued
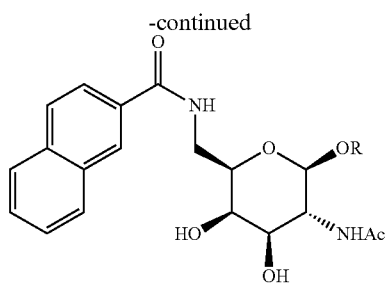
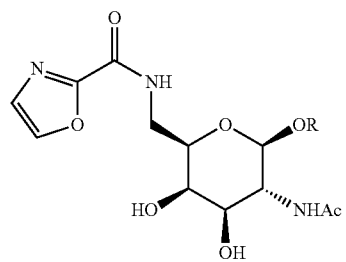
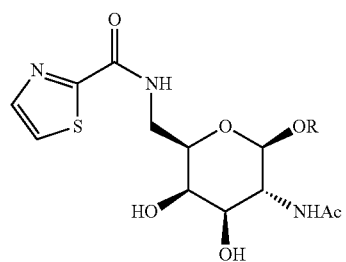
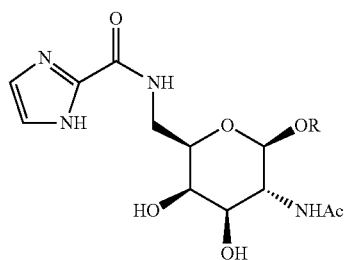
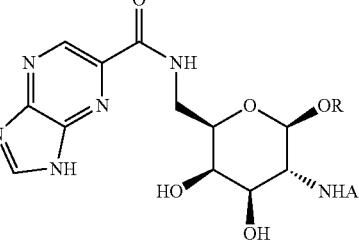
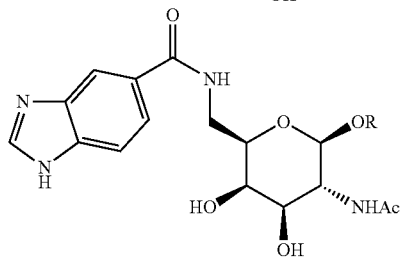
-continued
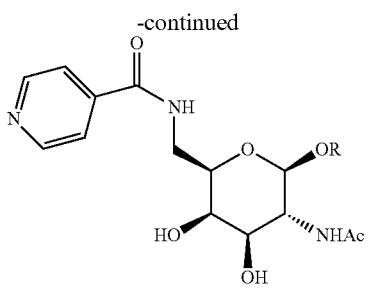
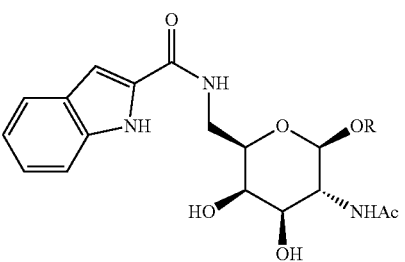
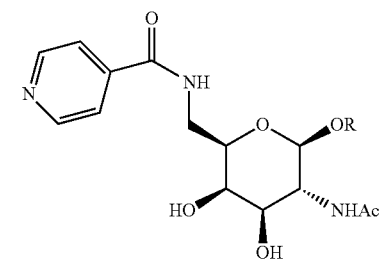
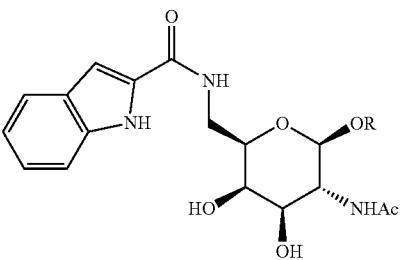
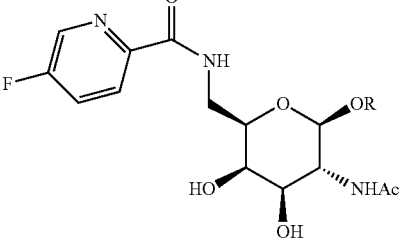
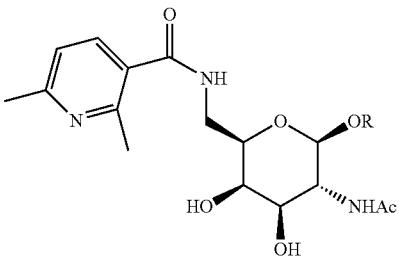

277
-continued
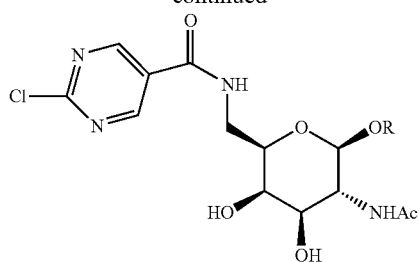
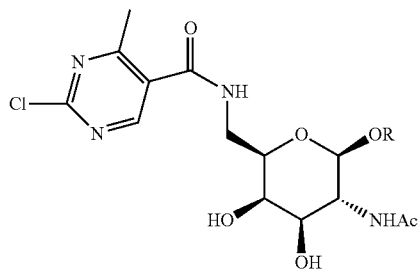
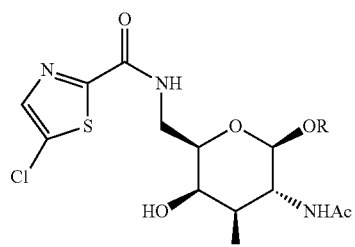
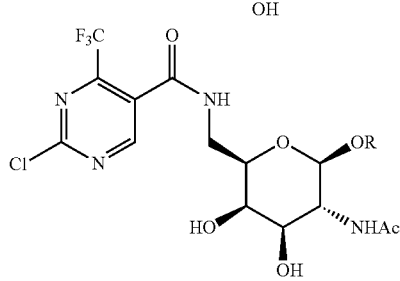
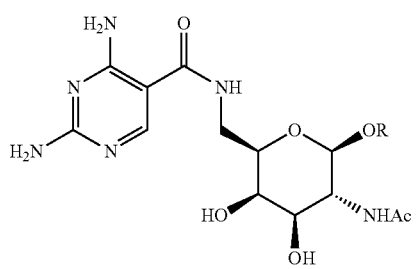
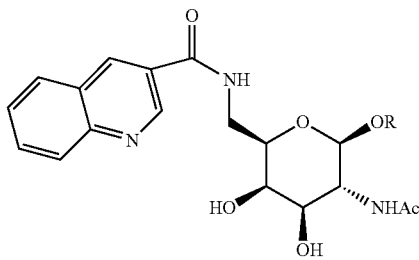
PFPlinker = 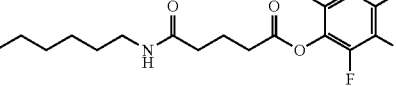
278
-continued
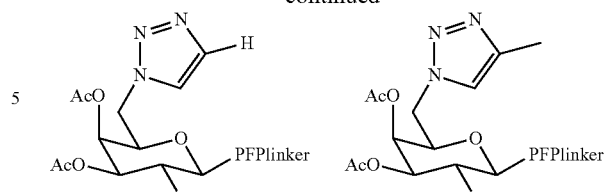
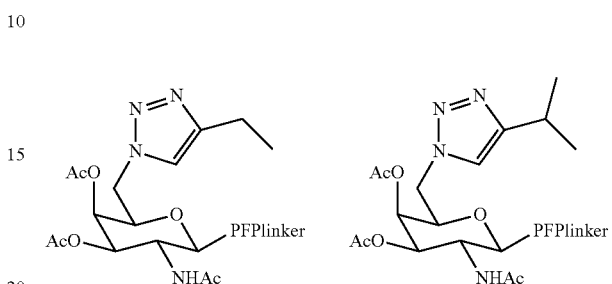
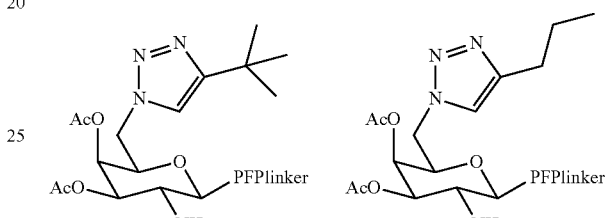
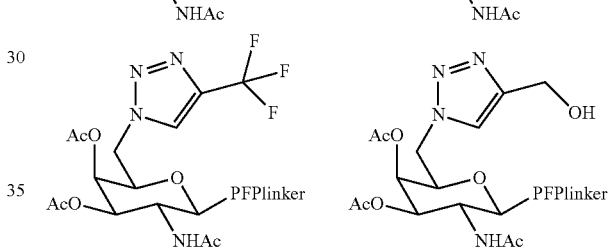
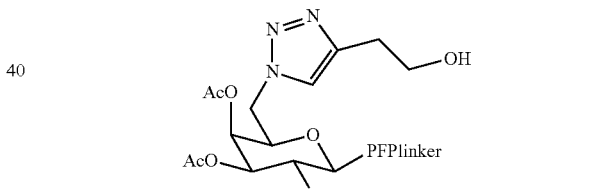
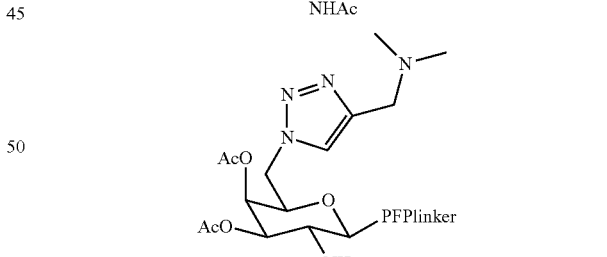
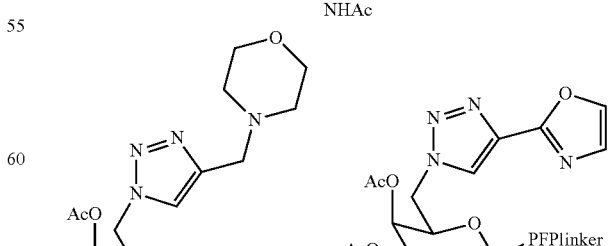

Certain modified GalNAc structures shown above are synthesized via the following scheme:

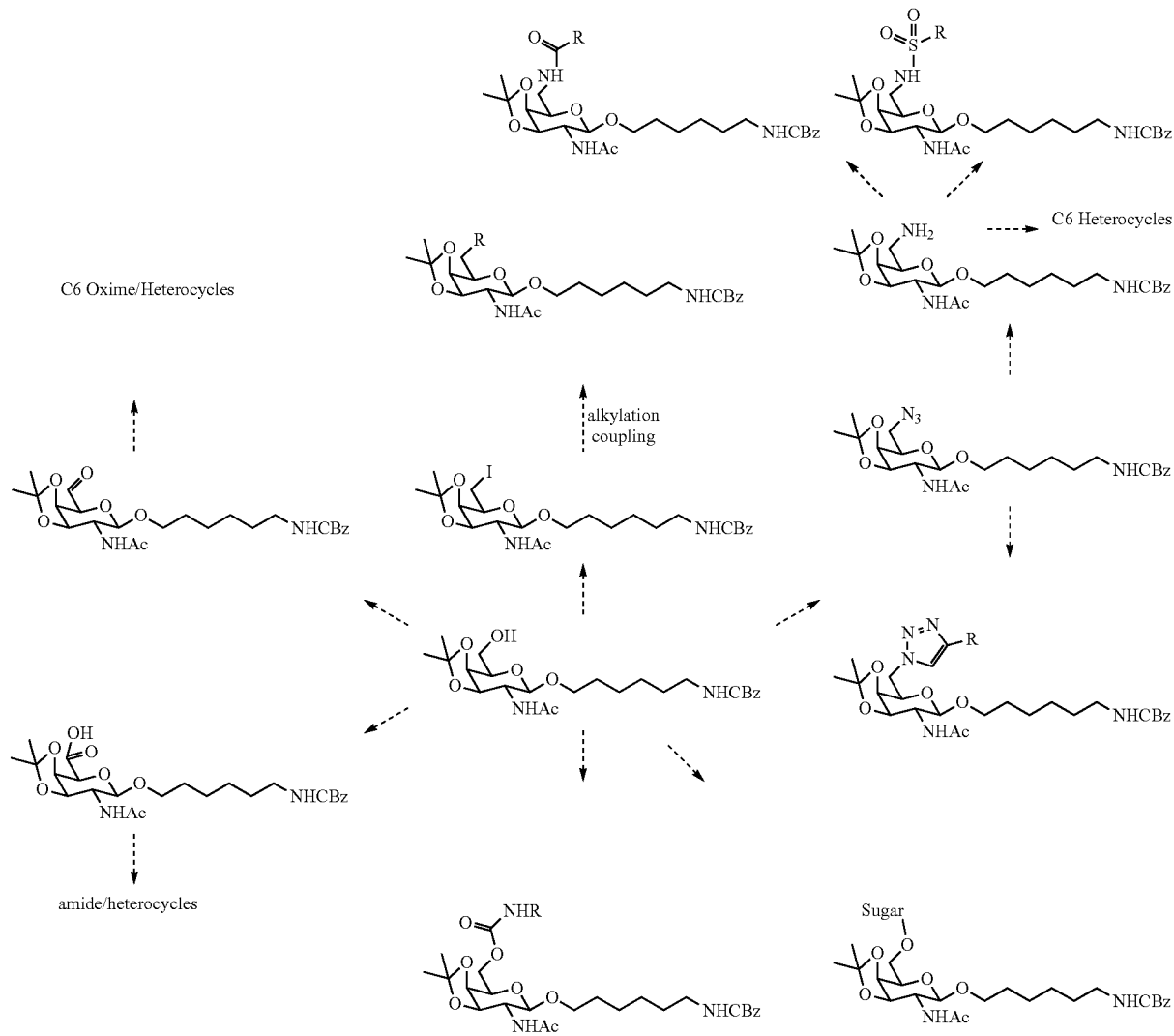

Example 22: Dose-Dependent Study of Modified Oligonucleotides Targeting SRB1 In Vivo The compounds in Table 33 were designed to target mouse SRB1. Wild type mice were injected subcutaneously once with a modified oligonucleotide listed in Table 33 at 0.2, 0.6, 2.0, or 6.0 mg/kg. A control group was injected subcutaneously with PBS. Each treatment group consisted of 2-4 animals. The mice were sacrificed 72 hours following oligonucleotide administration to determine the liver SRB1 mRNA levels using real-time PCR according to standard protocols. SRB1 mRNA levels were determined relative to total RNA (using RIBOGREEN®), prior to normalization to PBS treated control. The average percent of SRB1 mRNA levels for each treatment group relative to the average for the PBS treated group were used to calculate $ED_{50}$'s via non-linear regression. The results below illustrate that the oligonucleotide comprising one, modified GalNAc sugar (GalNAc$_1$-34$_a$) was more potent than the oligonucleotide comprising one, unmodified GalNAc sugar (GalNAc$_1$-37$_a$).

TABLE 33

Activity of modified oligonucleotides targeting mouse SRB1

| Isis No. | Sequence | $ED_{50}$ (mg/kg) | SEQ ID NO. |
|---|---|---|---|
| 780123 | GalNAc$_1$-37$_{a-o}$·T$_{ks}$ $^m$C$_{ks}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{ks}$ $^m$C$_k$ | 0.99 | 144 |
| 780121 | GalNAc$_1$-34$_{a-o}$·T$_{ks}$ $^m$C$_{ks}$ A$_{ds}$ G$_{ds}$ T$_{ds}$ $^m$C$_{ds}$ A$_{ds}$ T$_{ds}$ G$_{ds}$ A$_{ds}$ $^m$C$_{ds}$ T$_{ds}$ T$_{ks}$ $^m$C$_k$ | 0.70 | 144 |

The structures of GalNAc$_1$-34$_a$ and GalNAc$_1$-37$_a$ are described above and shown in Examples 9 and 20, respectively.

Example 23: Single Close Study of Modified Oligonucleotides Targeting SRB1 In Vivo The compounds in Table 34 were designed to target mouse SRB1. Wild type mice were injected subcutaneously once with a modified oligonucleotide listed in Table 34 at 4.5 mg/kg. A control group was injected subcutaneously with PBS. Each treatment group consisted of 2-4 animals. The mice were sacrificed 72 hours following oligonucleotide administration to determine the liver SRB1 mRNA levels using real-time PCR according to standard protocols. SRB1 mRNA levels were determined relative to total RNA (using RIBOGREEN®), prior to normalization to PBS treated control. The results below are presented as the average percent of SRB1 mRNA levels for each treatment group relative to the average for the PBS treated group. The results below illustrate that the oligonucleotides comprising various modified GalNAc sugars decreased target mRNA levels and several oligonucleotides comprising various modified GalNAc sugars were more potent than the oligonucleotide comprising an unmodified GalNAc sugar (GalNAc$_1$-37$_a$).

The structures of GalNAc$_1$-34$_a$ and GalNAc$_1$-37$_a$ are described above and shown in Examples 9 and 20, respectively. Compounds comprising GalNAc$_1$-38$_a$, GalNAc$_1$-39$_a$, GalNAc$_1$-40$_a$, GalNAc$_1$-41$_a$, and GalNAc$_1$-42$_a$ were made using synthetic routes described herein, routes similar to those described herein, or reactions known in the art. The structures are shown below:

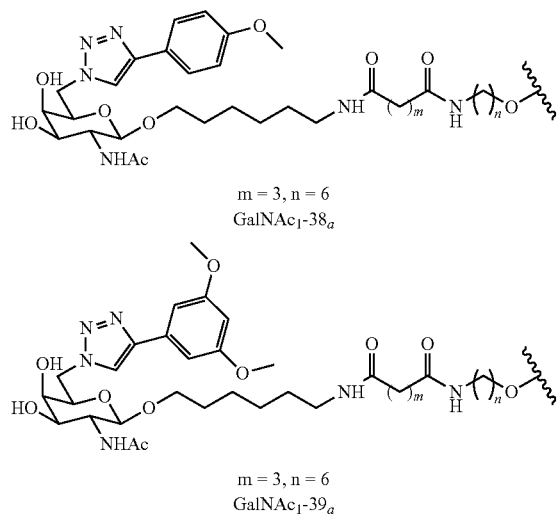

TABLE 34

Activity of modified oligonucleotides targeting mouse SRB1

| Isis No. | Sequence | SRB1 mRNA (% PBS) | SEQ ID NO. |
|---|---|---|---|
| 736690 | GalNAc$_1$-37$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 41 | 142 |
| 727852 | GalNAc$_1$-34$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 35 | 142 |
| 748826 | GalNAc$_1$-38$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 35 | 142 |
| 748828 | GalNAc$_1$-39$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 35 | 142 |
| 750494 | GalNAc$_1$-40$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 43 | 142 |
| 750493 | GalNAc$_1$-41$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 43 | 142 |
| 752377 | GalNAc$_1$-42$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 38 | 142 |

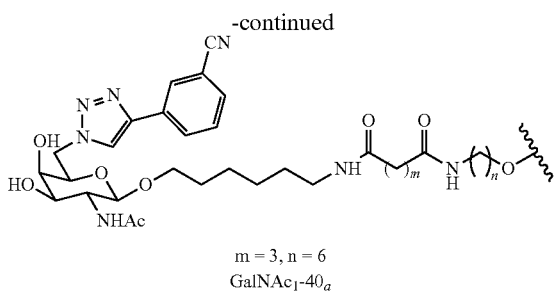

m = 3, n = 6
GalNAc₁-40ₐ

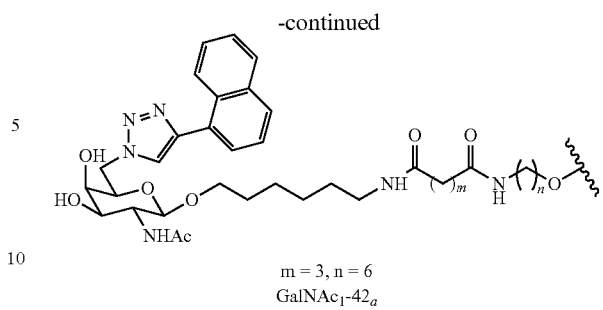

m = 3, n = 6
GalNAc₁-42ₐ

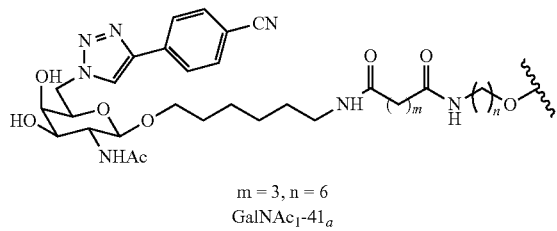

m = 3, n = 6
GalNAc₁-41ₐ

Example 24: Single Close Study of Modified Oligonucleotides Targeting SRB1 In Vivo The compounds in Table 35 were designed to target mouse SRB1. Wild type mice were injected subcutaneously once with a modified oligonucleotide listed in Table 35 at 4.5 mg/kg. A control group was injected subcutaneously with PBS. Each treatment group consisted of 2-4 animals. The mice were sacrificed 72 hours following oligonucleotide administration to determine the liver SRB1 mRNA levels using real-time PCR according to standard protocols. SRB1 mRNA levels were determined relative to total RNA (using RIBOGREEN®), prior to normalization to PBS treated control. The results below are presented as the average percent of SRB1 mRNA levels for each treatment group relative to the average for the PBS treated group. The results below illustrate that the oligonucleotides comprising various modified GalNAc sugars decreased target mRNA levels.

TABLE 35

Activity of modified oligonucleotides targeting mouse SRB1

| Isis No. | Sequence | SRB1 mRNA (% PBS) | SEQ ID NO. |
|---|---|---|---|
| 801359 | GalNAc$_1$-43$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 66 | 142 |
| 727852 | GalNAc$_1$-34$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 53 | 142 |
| 801353 | GalNAc$_1$-44$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 66 | 142 |
| 801360 | GalNAc$_1$-45$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 67 | 142 |
| 801357 | GalNAc$_1$-46$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 59 | 142 |
| 801358 | GalNAc$_1$-47$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 54 | 142 |
| 801354 | GalNAc$_1$-48$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 60 | 142 |

The structure of GalNAc$_1$-34$_a$ is described above and shown in Example 9. Compounds comprising GalNAc$_1$-43$_a$, GalNAc$_1$-44$_a$, GalNAc$_1$-45$_a$, GalNAc$_1$-46$_a$, GalNAc$_1$-47$_a$, and GalNAc$_1$-48$_a$ were made using synthetic routes described herein, routes similar to those described herein, or reactions known in the art. The structures are shown below:

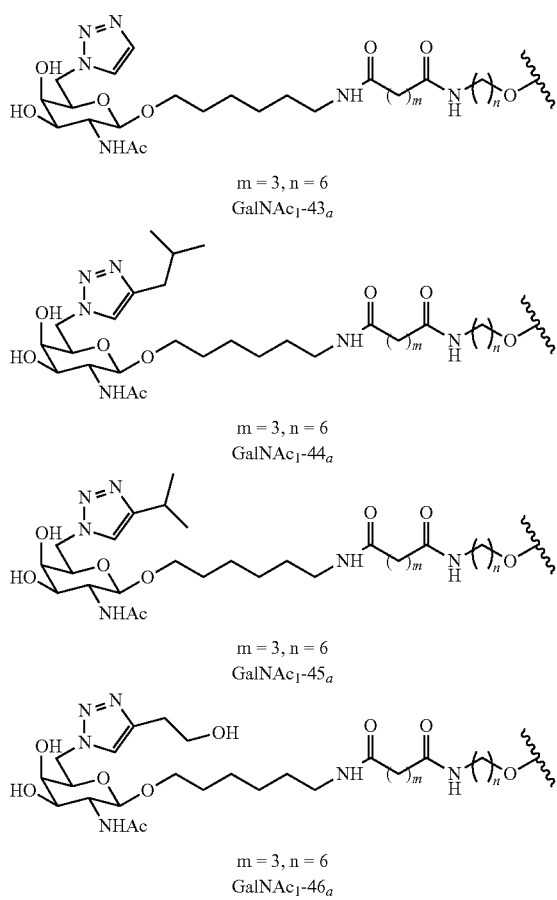

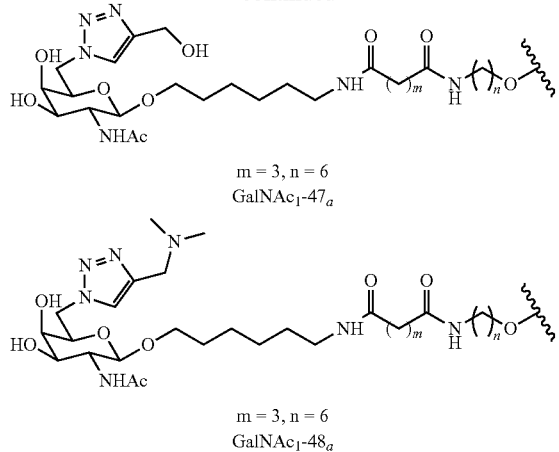

Example 25: Single Close Study of Modified Oligonucleotides Targeting SRB1 In Vivo The compounds in Table 36 were designed to target mouse SRB1. Wild type mice were injected subcutaneously once with a modified oligonucleotide listed in Table 36 at 4.5 mg/kg. A control group was injected subcutaneously with PBS. Each treatment group consisted of 2-4 animals. The mice were sacrificed 72 hours following oligonucleotide administration to determine the liver SRB1 mRNA levels using real-time PCR according to standard protocols. SRB1 mRNA levels were determined relative to total RNA (using RIBOGREEN®), prior to normalization to PBS treated control. The results below are presented as the average percent of SRB1 mRNA levels for each treatment group relative to the average for the PBS treated group. The results below illustrate that the oligonucleotides comprising various modified GalNAc sugars decreased target mRNA levels and several oligonucleotides comprising various modified GalNAc sugars were more potent than the oligonucleotide comprising an unmodified GalNAc sugar (GalNAc$_1$-37$_a$).

TABLE 36

Activity of modified oligonucleotides targeting mouse SRB1

| Isis No. | Sequence | SRB1 mRNA (% PBS) | SEQ ID NO. |
|---|---|---|---|
| 736690 | GalNAc$_1$-37$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 55 | 142 |
| 727852 | GalNAc$_1$-34$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 42 | 142 |
| 761852 | GalNAc$_1$-49$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 57 | 142 |
| 761853 | GalNAc$_1$-50$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 54 | 142 |
| 761854 | GalNAc$_1$-51$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 52 | 142 |

The structures of GalNAc$_1$-34$_a$ and GalNAc$_1$-37$_a$ are described above and shown in Examples 9 and 20, respectively. Compounds comprising GalNAc$_1$-49$_a$, GalNAc$_1$-50$_a$, and GalNAc$_1$-51$_a$ were made using synthetic routes described herein, routes similar to those described herein, or reactions known in the art. The structures are shown below:

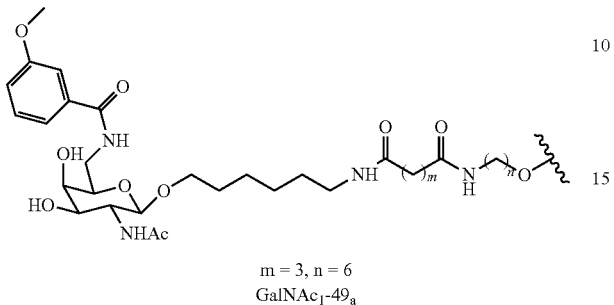

m = 3, n = 6
GalNAc$_1$-49$_a$

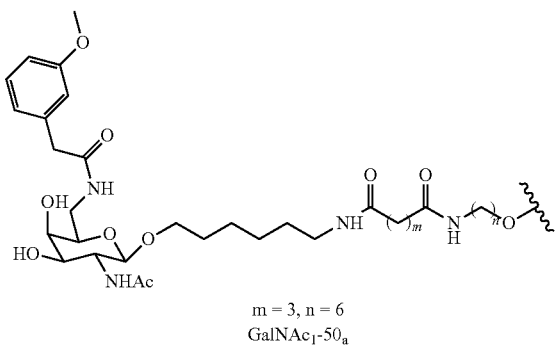

m = 3, n = 6
GalNAc$_1$-50$_a$

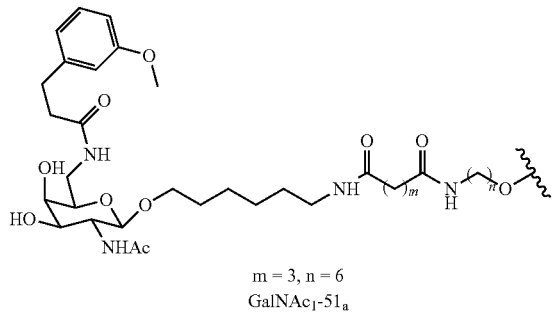

m = 3, n = 6
GalNAc$_1$-51$_a$

Example 26: Single Close Study of Modified Oligonucleotides Targeting SRB1 In Vivo The compounds in Table 37 were designed to target mouse SRB1. Wild type mice were injected subcutaneously once with a modified oligonucleotide listed in Table 37 at 4.5 mg/kg. A control group was injected subcutaneously with PBS. Each treatment group consisted of 2-4 animals. The mice were sacrificed 72 hours following oligonucleotide administration to determine the liver SRB1 mRNA levels using real-time PCR according to standard protocols. SRB1 mRNA levels were determined relative to total RNA (using RIBOGREEN®), prior to normalization to PBS treated control. The results below are presented as the average percent of SRB1 mRNA levels for each treatment group relative to the average for the PBS treated group. The results below illustrate that the oligonucleotides comprising various modified GalNAc sugars decreased target mRNA levels and several oligonucleotides comprising various modified GalNAc sugars were more potent than the oligonucleotide comprising an unmodified GalNAc sugar (GalNAc$_1$-37$_a$).

TABLE 37

Activity of modified oligonucleotides targeting mouse SRB1

| Isis No. | Sequence | SRB1 mRNA (% PBS) | SEQ ID NO. |
| --- | --- | --- | --- |
| 736690 | GalNAc$_1$-37$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 29 | 142 |
| 727852 | GalNAc$_1$-34$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 23 | 142 |
| 790394 | GalNAc$_1$-52$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 33 | 142 |
| 790437 | GalNAc$_1$-53$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 29 | 142 |
| 789773 | GalNAc$_1$-54$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 29 | 142 |
| 789793 | GalNAc$_1$-55$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 33 | 142 |
| 790393 | GalNAc$_1$-56$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 26 | 142 |
| 789774 | GalNAc$_1$-57$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 33 | 142 |
| 790436 | GalNAc$_1$-58$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 28 | 142 |

The structures of GalNAc₁-34ₐ and GalNAc₁-37ₐ are described above and shown in Examples 9 and 20, respectively. Compounds comprising GalNAc₁-52ₐ, GalNAc₁-53ₐ, GalNAc₁-54ₐ, GalNAc₁-55ₐ, GalNAc₁-56ₐ, GalNAc₁-57ₐ, and GalNAc₁-58ₐ were made using synthetic routes described herein, routes similar to those described herein, or reactions known in the art. The structures are shown below:

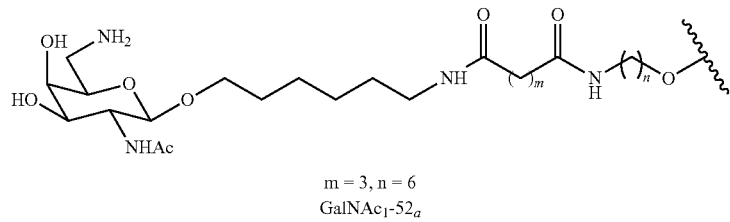

m = 3, n = 6
GalNAc₁-52ₐ

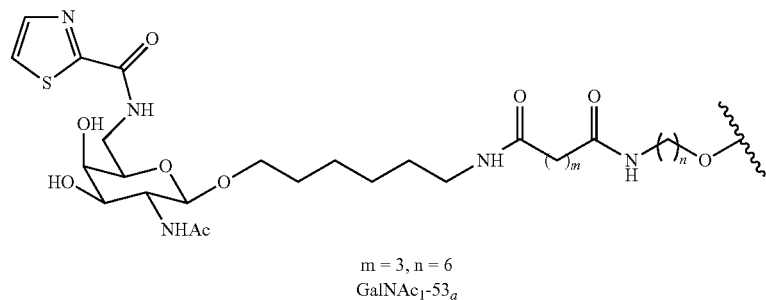

m = 3, n = 6
GalNAc₁-53ₐ

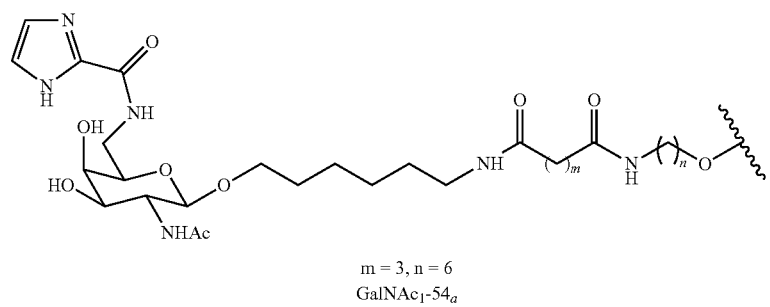

m = 3, n = 6
GalNAc₁-54ₐ

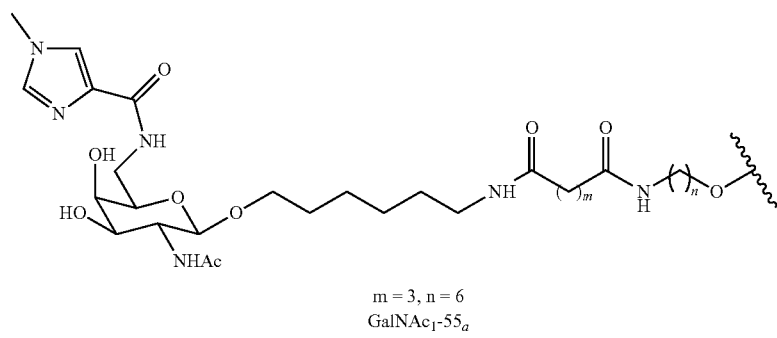

m = 3, n = 6
GalNAc₁-55ₐ

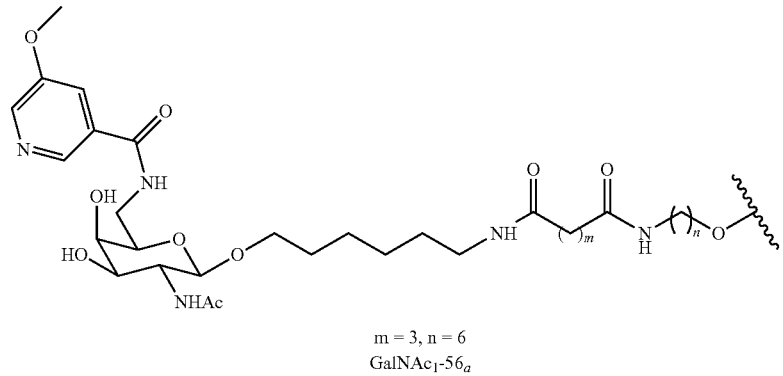

m = 3, n = 6
GalNAc₁-56ₐ

-continued

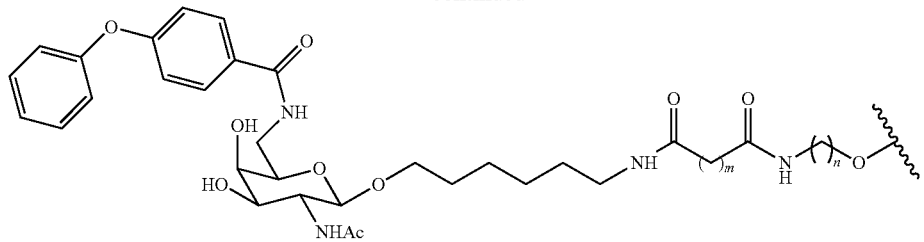

m = 3, n = 6
GalNAc$_1$-57$_a$

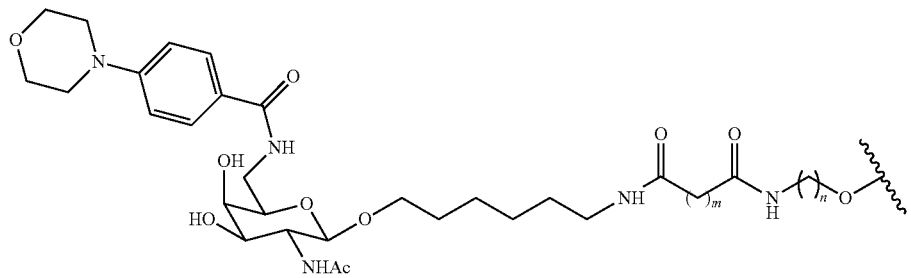

m = 3, n = 6
GalNAc$_1$-58$_a$

Example 27: Single Close Study of Modified Oligonucleotides Targeting SRB1 In Vivo The compounds in Table 38 were designed to target mouse SRB1. Wild type mice were injected subcutaneously once with a modified oligonucleotide listed in Table 38 at 4.5 mg/kg. A control group was injected subcutaneously with PBS. Each treatment group consisted of 2-4 animals. The mice were sacrificed 72 hours following oligonucleotide administration to determine the liver SRB1 mRNA levels using real-time PCR according to standard protocols. SRB1 mRNA levels were determined relative to total RNA (using RIBOGREEN®), prior to normalization to PBS treated control. The results below are presented as the average percent of SRB1 mRNA levels for each treatment group relative to the average for the PBS treated group. The results below illustrate that the oligonucleotides comprising various modified GalNAc sugars decreased target mRNA levels and several oligonucleotides comprising various modified GalNAc sugars were more potent than the oligonucleotide comprising an unmodified GalNAc sugar (GalNAc$_1$-37$_a$).

TABLE 38

Activity of modified oligonucleotides targeting mouse SRB1

| Isis No. | Sequence | SRB1 mRNA (% PBS) | SEQ ID NO. |
|---|---|---|---|
| 736690 | GalNAc$_1$-37$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 41 | 142 |
| 752534 | GalNAc$_1$-59$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 36 | 142 |
| 752533 | GalNAc$_1$-60$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 39 | 142 |
| 736694 | GalNAc$_1$-61$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 45 | 142 |
| 754154 | GalNAc$_1$-62$_{a-o}$,G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 51 | 142 |

The structure of GalNAc$_1$-37$_a$ is described above and shown in Example 20. Compounds comprising GalNAc$_1$-59$_a$, GalNAc$_1$-60$_a$, GalNAc$_1$-61$_a$, and GalNAc$_1$-62$_a$ were made using synthetic routes described herein, routes similar to those described herein, or reactions known in the art. The structures are shown below:

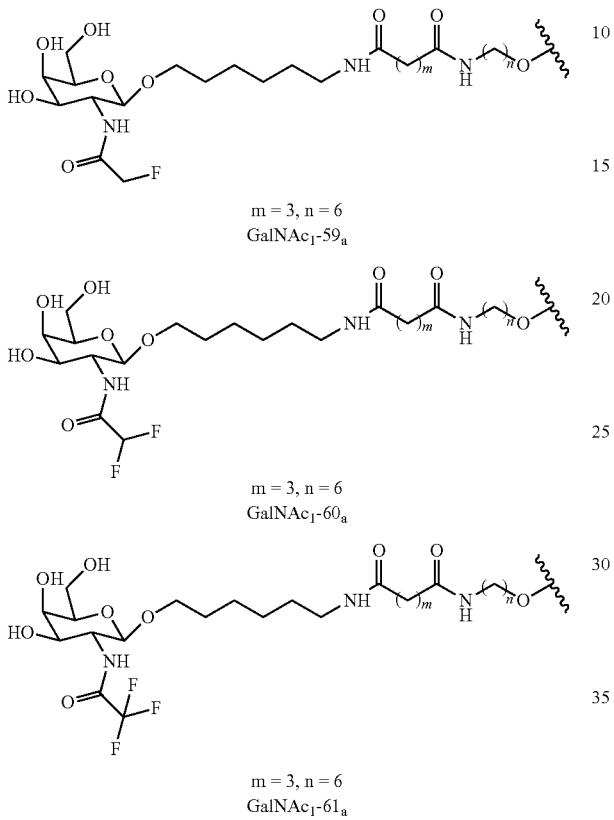

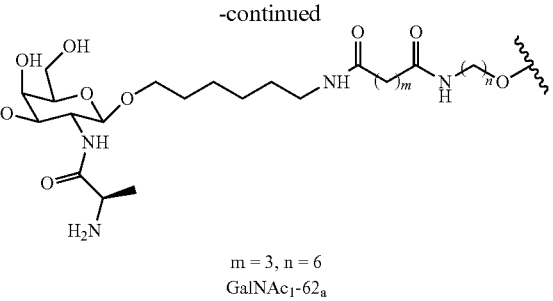

m = 3, n = 6
GalNAc$_1$-62$_a$

Example 28: Single Close Study of Modified Oligonucleotides Targeting SRB1 In Vivo The compounds in Table 39 were designed to target mouse SRB1. Wild type mice were injected subcutaneously once with a modified oligonucleotide listed in Table 39 at 4.5 mg/kg. A control group was injected subcutaneously with PBS. Each treatment group consisted of 2-4 animals. The mice were sacrificed 72 hours following oligonucleotide administration to determine the liver SRB1 mRNA levels using real-time PCR according to standard protocols. SRB1 mRNA levels were determined relative to total RNA (using RIBOGREEN®), prior to normalization to PBS treated control. The results below are presented as the average percent of SRB1 mRNA levels for each treatment group relative to the average for the PBS treated group. The results below illustrate that the oligonucleotides comprising various modified GalNAc sugars decreased target mRNA levels and several oligonucleotides comprising various modified GalNAc sugars were more potent than the oligonucleotide comprising an unmodified GalNAc sugar (GalNAc$_1$-37$_a$).

TABLE 39

Activity of modified oligonucleotides targeting mouse SRB1

| Isis No. | Sequence | SRB1 mRNA (% PBS) | SEQ ID NO. |
|---|---|---|---|
| 736690 | GalNAc$_1$-37$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 41 | 142 |
| 748827 | GalNAc$_1$-63$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 77 | 142 |
| 739254 | GalNAc$_1$-64$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 90 | 142 |
| 739233 | GalNAc$_1$-65$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 78 | 142 |
| 737333 | GalNAc$_1$-66$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 91 | 142 |
| 736689 | GalNAc$_1$67$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 98 | 142 |

The structure of GalNAc₁-37ₐ is described above and shown in Example 20. Compounds comprising GalNAc₁-63ₐ, GalNAc₁-64ₐ, GalNAc₁-65ₐ, GalNAc₁-66ₐ, and GalNAc₁-67ₐ were made using synthetic routes described herein, routes similar to those described herein, or reactions known in the art. The structures are shown below:

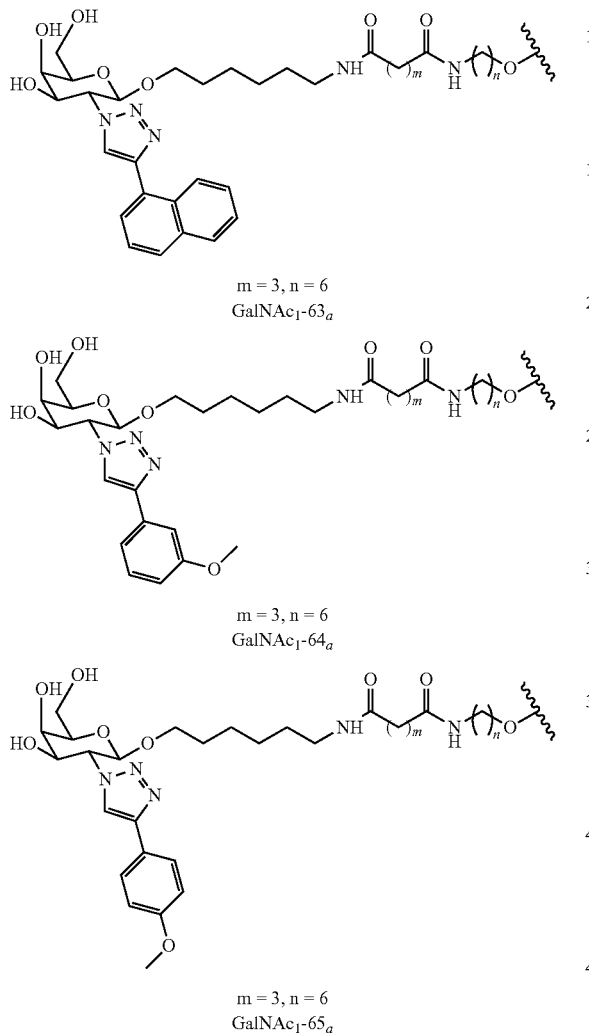

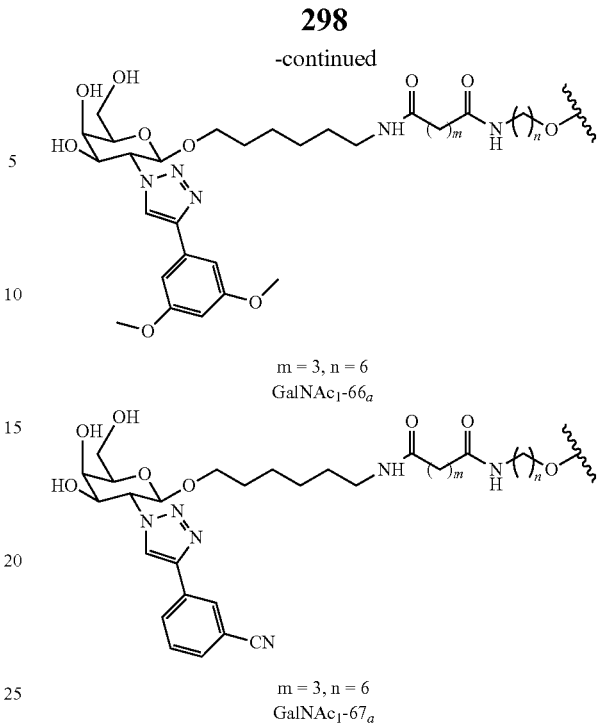

Example 29: Single Close Study of Modified Oligonucleotides Targeting SRB1 In Vivo The compounds in Table 40 were designed to target mouse SRB1. Wild type mice were injected subcutaneously once with a modified oligonucleotide listed in Table 40 at 4.5 mg/kg. A control group was injected subcutaneously with PBS. Each treatment group consisted of 2-4 animals. The mice were sacrificed 72 hours following oligonucleotide administration to determine the liver SRB1 mRNA levels using real-time PCR according to standard protocols. SRB1 mRNA levels were determined relative to total RNA (using RIBOGREEN®), prior to normalization to PBS treated control. The results below are presented as the average percent of SRB1 mRNA levels for each treatment group relative to the average for the PBS treated group. The results below illustrate that the oligonucleotides comprising various modified GalNAc sugars decreased target mRNA levels and several oligonucleotides comprising various modified GalNAc sugars were more potent than the oligonucleotide comprising an unmodified GalNAc sugar (GalNAc₁-37ₐ).

TABLE 40

Activity of modified oligonucleotides targeting mouse SRB1

| Isis No. | Sequence | SRB1 mRNA (% PBS) | SEQ ID NO. |
|---|---|---|---|
| 736690 | GalNAc₁-37ₐ₋ₒ, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 67 | 142 |
| 727852 | GalNAc₁-34ₐ₋ₒ, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 53 | 142 |
| 801355 | GalNAc₁-68ₐ₋ₒ, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 67 | 142 |
| 801356 | GalNAc₁-69ₐ₋ₒ, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 66 | 142 |

TABLE 40-continued

Activity of modified oligonucleotides targeting mouse SRB1

| Isis No. | Sequence | SRB1 mRNA (% PBS) | SEQ ID NO. |
|---|---|---|---|
| 801373 | GalNAc$_1$-70$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_e$ | 50 | 142 |

The structures of GalNAc$_1$-34$_a$ and GalNAc$_1$-37$_a$ are described above and shown in Examples 9 and 20, respectively. Compounds comprising GalNAc$_1$-68$_a$, GalNAc$_1$-69$_a$, and GalNAc$_1$-70$_a$ were made using synthetic routes described herein, routes similar to those described herein, or reactions known in the art. The structures are shown below:

PBS. Each treatment group consisted of 2-4 animals. The mice were sacrificed 72 hours following oligonucleotide administration to determine the liver SRB1 mRNA levels using real-time PCR according to standard protocols. SRB1 mRNA levels were determined relative to total RNA (using RIBOGREEN®), prior to normalization to PBS treated

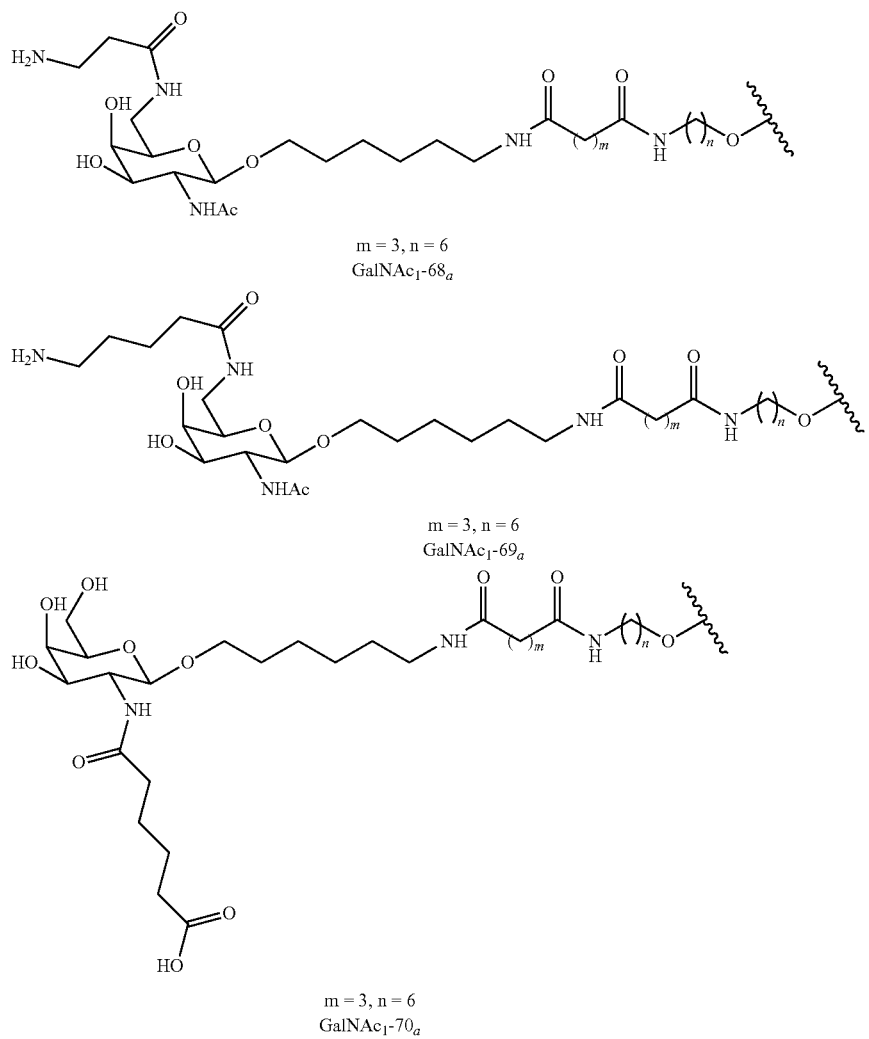

m = 3, n = 6
GalNAc$_1$-68$_a$ m = 3, n = 6
GalNAc$_1$-69$_a$ m = 3, n = 6
GalNAc$_1$-70$_a$

Example 30: Single Close Study of Modified Oligonucleotides Targeting SRB1 In Vivo The compounds in Table 41 were designed to target mouse SRB1. Wild type mice were injected subcutaneously once with a modified oligonucleotide listed in Table 41 at 4.5 mg/kg. A control group was injected subcutaneously with control. The results below are presented as the average percent of SRB1 mRNA levels for each treatment group relative to the average for the PBS treated group. The results below illustrate that the oligonucleotides comprising various modified GalNAc sugars decreased target mRNA levels and several oligonucleotides comprising various modified GalNAc sugars were more potent than the oligonucleotide comprising an unmodified GalNAc sugar (GalNAc$_1$-37$_a$).

TABLE 41

Activity of modified oligonucleotides targeting mouse SRB1

| Isis No. | Sequence | SRB1 mRNA (% PBS) | SEQ ID NO. |
|---|---|---|---|
| 736690 | GalNAc$_1$-37$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 41 | 142 |
| 727852 | GalNAc$_1$-34$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 35 | 142 |
| 752534 | GalNAc$_1$-59$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 36 | 142 |
| 801374 | GalNAc$_1$-71$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 54 | 142 |

The structures of GalNAc$_1$-34$_a$, GalNAc$_1$-37$_a$, and GalNAc$_1$-59$_a$ are described above and shown in Examples 9, 20, and 27, respectively. Isis No. 801374, comprising GalNAc$_1$-71$_a$, was made using synthetic routes described herein, routes similar to those described herein, or reactions known in the art. The structures are shown below:

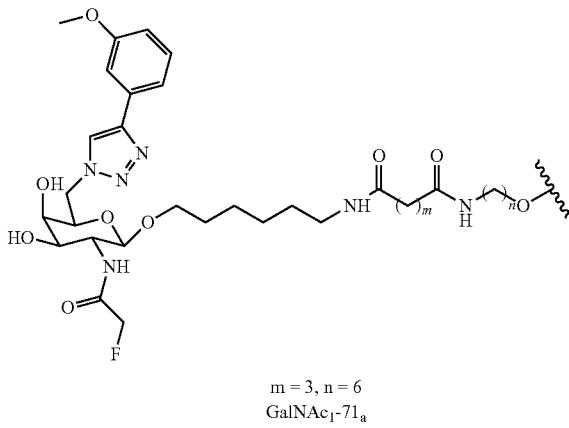

m = 3, n = 6
GalNAc$_1$-71$_a$

Example 31: Single Close Study of Modified Oligonucleotides Targeting SRB1 In Vivo The compounds in Table 42 were designed to target mouse SRB1. Wild type mice were injected subcutaneously once with a modified oligonucleotide listed in Table 42 at 4.5 mg/kg. A control group was injected subcutaneously with PBS. Each treatment group consisted of 2-4 animals. The mice were sacrificed 72 hours following oligonucleotide administration to determine the liver SRB1 mRNA levels using real-time PCR according to standard protocols. SRB1 mRNA levels were determined relative to total RNA (using RIBOGREEN®), prior to normalization to PBS treated control. The results below are presented as the average percent of SRB1 mRNA levels for each treatment group relative to the average for the PBS treated group. The results below illustrate that the oligonucleotides comprising various modified GalNAc sugars decreased target mRNA levels and were more potent than the oligonucleotide comprising one unmodified GalNAc sugar (GalNAc$_1$-37$_a$) and no modified GalNAc sugars.

TABLE 42

Activity of modified oligonucleotides targeting mouse SRB1

| Isis No. | Sequence | SRB1 mRNA (% PBS) | SEQ ID NO. |
|---|---|---|---|
| 736690 | GalNAc$_1$-37$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 55 | 142 |
| 727852 | GalNAc$_1$-34$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 44 | 142 |
| 765153 | GalNAc$_2$-72$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 49 | 142 |
| 765154 | GalNAc$_1$-73$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 51 | 142 |

The structures of GalNAc$_1$-34$_a$ and GalNAc$_1$-37$_a$ are described above and shown in Examples 9 and 20, respectively. Compounds comprising GalNAc$_2$-72$_a$ and GalNAc$_1$-73$_a$ were made using synthetic routes described herein, routes similar to those described herein, or reactions known in the art. The structures are shown below:

PBS. Each treatment group consisted of 2-4 animals. The mice were sacrificed 72 hours following oligonucleotide administration to determine the liver SRB1 mRNA levels using real-time PCR according to standard protocols. SRB1 mRNA levels were determined relative to total RNA (using

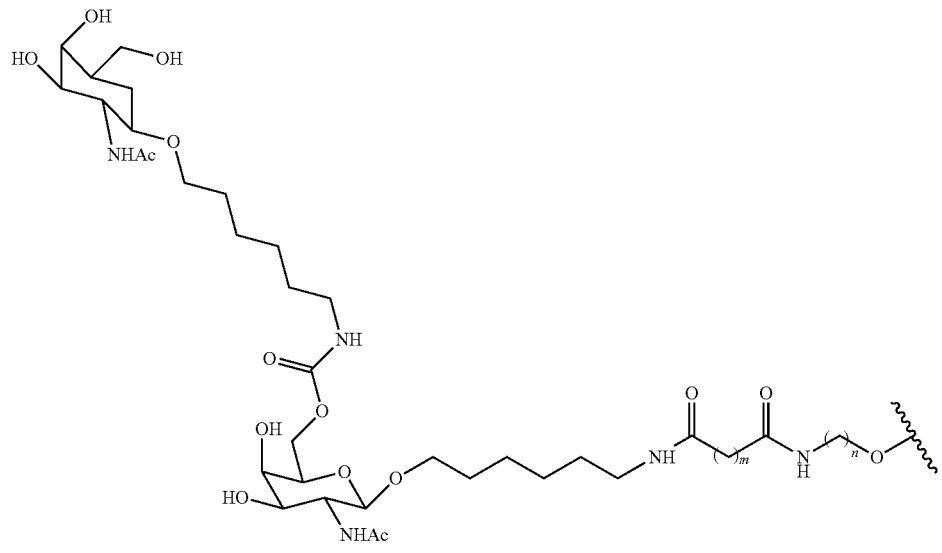

m = 3, n = 6
GalNAc$_1$-72$_a$

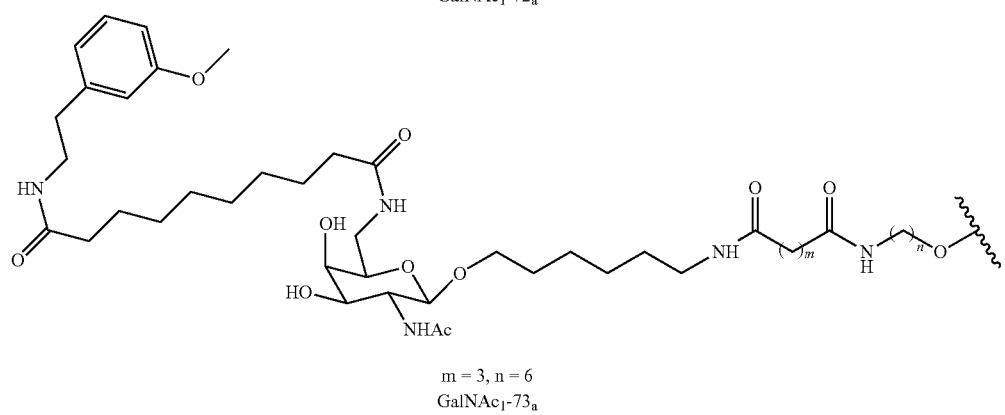

m = 3, n = 6
GalNAc$_1$-73$_a$

Example 32: Single Close Study of Modified Oligonucleotides Targeting SRB1 In Vivo The compounds in Table 43 were designed to target mouse SRB1. Wild type mice were injected subcutaneously once with a modified oligonucleotide listed in Table 43 at 4.5 mg/kg. A control group was injected subcutaneously with RIBOGREEN®), prior to normalization to PBS treated control. The results below are presented as the average percent of SRB1 mRNA levels for each treatment group relative to the average for the PBS treated group. The results below illustrate that the oligonucleotides comprising various modified GalNAc sugars decreased target mRNA levels.

TABLE 43

Activity of modified oligonucleotides targeting mouse SRB1

| Isis No. | Sequence | SRB1 mRNA (% PBS) | SEQ ID NO. |
|---|---|---|---|
| 736690 | GalNAc$_1$37$_{a-o'}$ G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 41 | 142 |
| 727852 | GalNAc$_1$-34$_{a-o'}$ G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 43 | 142 |

TABLE 43-continued

Activity of modified oligonucleotides targeting mouse SRB1

| Isis No. | Sequence | SRB1 mRNA (% PBS) | SEQ ID NO. |
|---|---|---|---|
| 761854 | GalNAc$_1$-51$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 52 | 142 |
| 761855 | GalNAc$_1$-74$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 51 | 142 |

The structures of GalNAc$_1$-34$_a$, GalNAc$_1$-37$_a$, and GalNAc$_1$-51$_a$ are described above and shown in Examples 9, 20, and 32, respectively. Isis No. 761855 comprising GalNAc$_1$-74$_a$ was made using synthetic routes described herein, routes similar to those described herein, or reactions known in the art. The structures are shown below:

control. The results below are presented as the average percent of SRB1 mRNA levels for each treatment group relative to the average for the PBS treated group. The results below illustrate that the oligonucleotides comprising various modified GalNAc sugars decreased target mRNA levels.

TABLE 44

Activity of modified oligonucleotides targeting mouse SRB1

| Isis No. | Sequence | SRB1 mRNA (% PBS) | SEQ ID NO. |
|---|---|---|---|
| 736690 | GalNAc$_1$-37$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 41 | 142 |
| 801359 | GalNAc$_1$-43$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 52 | 142 |
| 752376 | GalNAc$_1$-75$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 38 | 142 |
| 790394 | GalNAc$_1$52$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_e$ | 33 | 142 |

The structures of GalNAc$_1$-37$_a$, GalNAc$_1$-43$_a$, and GalNAc$_1$-52$_a$ are described above and shown in Examples 20, 24, and 26, respectively. Isis No. 752376 comprising GalNAc$_1$-75$_a$ was made using synthetic routes described herein, routes similar to those described herein, or reactions known in the art. The structures are shown below:

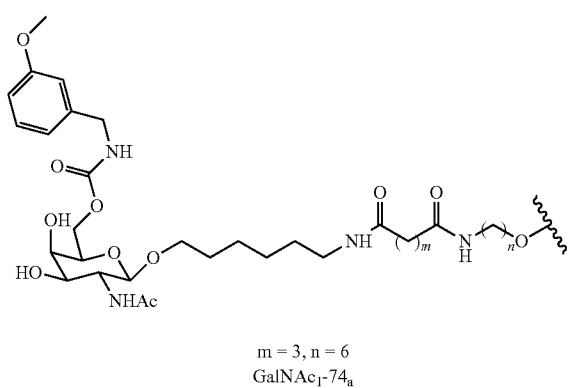

m = 3, n = 6
GalNAc$_1$-74$_a$

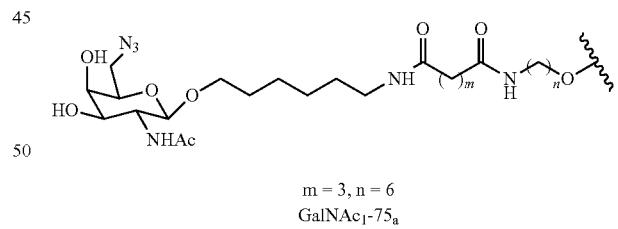

m = 3, n = 6
GalNAc$_1$-75$_a$

Example 33: Single Close Study of Modified Oligonucleotides Targeting SRB1 In Vivo The compounds in Table 44 were designed to target mouse SRB1. Wild type mice were injected subcutaneously once with a modified oligonucleotide listed in Table 44 at 4.5 mg/kg. A control group was injected subcutaneously with PBS. Each treatment group consisted of 2-4 animals. The mice were sacrificed 72 hours following oligonucleotide administration to determine the liver SRB1 mRNA levels using real-time PCR according to standard protocols. SRB1 mRNA levels were determined relative to total RNA (using RIBOGREEN®), prior to normalization to PBS treated

Example 34: Single Close Study of Modified Oligonucleotides Targeting SRB1 In Vivo The compounds in Table 45 were designed to target mouse SRB1. Wild type mice were injected subcutaneously once with a modified oligonucleotide listed in Table 45 at 4.5 mg/kg. A control group was injected subcutaneously with PBS. Each treatment group consisted of 2-4 animals. The mice were sacrificed 72 hours following oligonucleotide administration to determine the liver SRB1 mRNA levels using real-time PCR according to standard protocols. SRB1 mRNA levels were determined relative to total RNA (using RIBOGREEN®), prior to normalization to PBS treated control. The results below are presented as the average percent of SRB1 mRNA levels for each treatment group relative to the average for the PBS treated group. The results below illustrate that the oligonucleotides comprising Gal-NAc sugars decreased target mRNA levels.

TABLE 45

Activity of modified oligonucleotides targeting mouse SRB1

| Isis No. | Sequence | SRB1 mRNA (% PBS) | SEQ ID NO. |
|---|---|---|---|
| 762827 | GalNAc$_1$-76$_{a-o}$, G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$ $^m$C$_{es}$$^m$C$_{es}$T$_{es}$T$_{eo}$ GalNAc$_1$-76$_a$ | 39 | 142 |
| 773493 | G$_{es}$$^m$C$_{es}$T$_{es}$T$_{es}$$^m$C$_{es}$A$_{ds}$G$_{ds}$T$_{ds}$$^m$C$_{ds}$A$_{ds}$T$_{ds}$G$_{ds}$A$_{ds}$$^m$C$_{ds}$T$_{ds}$T$_{es}$$^m$C$_{es}$$^m$C$_{es}$T$_{es}$T$_{eo}$GalNAc$_2$-77$_a$ | 44 | 142 |

Isis No. 762827 comprising GalNAc$_1$-76$_a$ at both the 5'-terminal nucleoside and GalNAc$_1$-76$_a$ at the 3'-terminal nucleoside was made using synthetic routes described herein, routes similar to those described herein, or reactions known in the art. Isis No. 773493 comprising GalNAc$_2$-77$_a$ was made using synthetic routes described herein, routes similar to those described herein, or reactions known in the art. The structures of GalNAc$_1$-76$_a$ and GalNAc$_2$-77$_a$ are shown below:

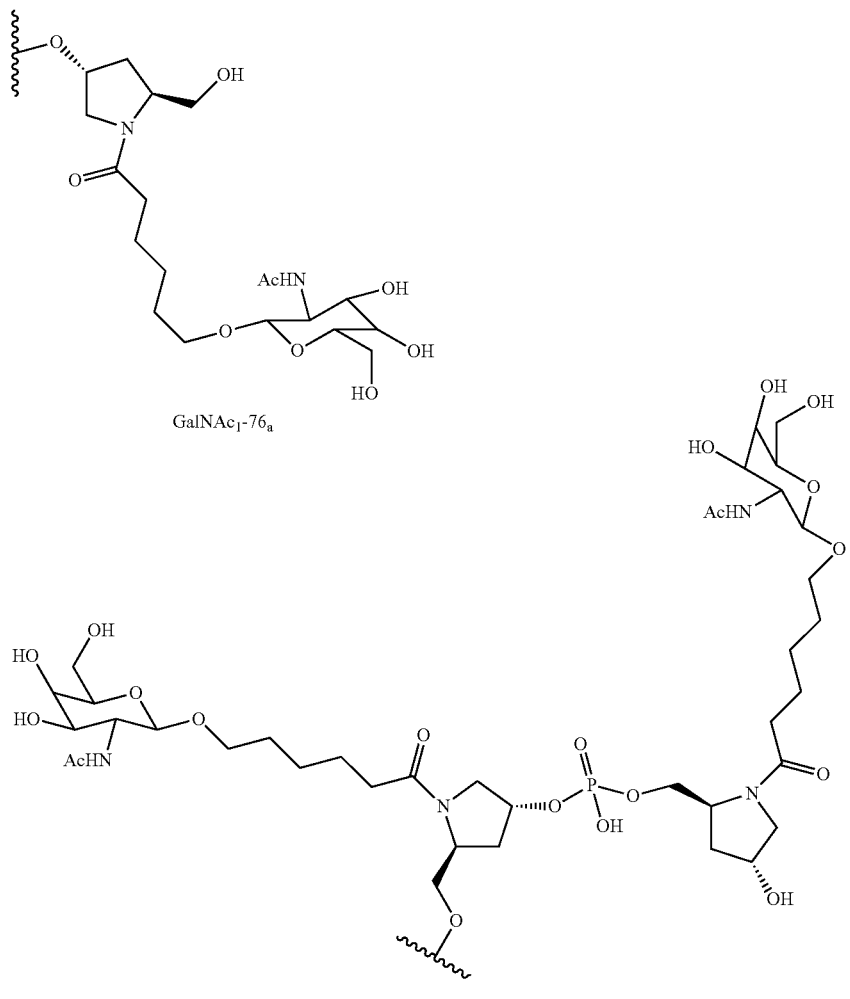

GalNAc$_1$-76$_a$

GalNAc$_1$-77$_a$

SEQUENCE LISTING (144 sequences)

SEQ ID NO: 1 - DNA, 191001 bp, Homo sapiens
ctgacagaaagcagatcattggttgcctgaggaggaggagtataggagaggtggagggaaaatgtacaaagtggcacaataaaaacttttggaatcatagatatattcactatcttgattgagtgatgatttcatgagtgcacgcgtgtgtcaaaaatgatcaatttatgcaactttaaatatgtgcagtttattgtatatatcaattatacctcagtacggctattaaaaagaaaccctctggctgcacaatgcagaactgattctaggaaagagtggagggaggatgaccatttacagtgctccaggtggaagagaacggtgccttctggaagtgaactaggttggcaacaacagagatgaaataaatgggcagatgtgtgagatacttaggaaataaaacccgatggtcaccattttccaaaggtcagctcatcctggctttccagagcaaagagctagggaagactttattaataaatccctcttgaagttgcagaggaagcttatagcagaaacttactctcaacctgactaatctgagagaacacctctggttccatttgattactaaaaaactgcaaagaacaggaggagaaagaagaagaaagctggtacaaacagtgaacttatataatattaatcaataattgtctcttgttcttaaaagcaatgggaagaaaatgagatttgagctggaagatcagagttcaaaatccaaataaagtatatggccctaatatgcttatagtagttaacctttcctgataatgatataattgttgacagcaccatctttaaaaataaaaataacatagtaatccttcagatttgtagaatgctttcctgtttacaagtttgttctatacacattatgtcttttaaatgacacactagccttctgagggtaacttatattggcaacagttttcagatgtggaaactgtgaagacaatgttggtgatgtggaagcaacataaactttggagtctttcagacccaggtttgaatgtcagactgctttttattcagagtaacttcagagcattatttctcaccttaattttttttcaggcctctttgtgtctatgtgtcctcttcactcctgtccattgttcattcagtgatttttgcaccttccttcactgttagtgtgtagacacatagttctcctggctctgagacctatgttaattccattctaccatcctgccagcccactcaattcctattgagcaatgctagttgaaagttgtggtgggattaaatgttgcaatgagtattcaaatgaggttgaagtatctacgcattctacttacatatggtgaggtatattcaaggaaggctgtagccattaaaatctcaggaaataatttttcacctcctcaggtgaaagggtcttcaggcctttgtgttctggaaggttcatttatagccatttcccaaatgacaatgcgattgatgagtctagagtctagctcaaatagcaatggactggaagactagtttaggttttactaatgtggaacatagaacaaattatgtccttgtttcagcctgttcatctgtgaaatagagcctatcatatccagtcttccttgcctttaggtttgagttaccttctttggtcaaggtaagtaaatgcctatgatgtttggctgtgcacaagataaagctacaacaaagctacaacccatcttttctctgtagaagactgcaaaaagcaaaagagacccaggcaaaaatctcggaatgacttttggaacagagagcctccccagaatcagaagtcaaaggaatttaaaacatagggaggcccagggtctctactgacataaaggaaagatgttttccttataggtttacgtttacattttctctctctttccattcccacttgcatctccacctttacacagggcttatgggacctcctccacaaaagagcagttgcagtaacccacatcatcctctacgcctggctgtccatcaagaggcgaaaagcagccctatataggttctatccttggatagttccagttgtaaagtttaaaatatgcgaaggcaacttggaaaagcaagcggctgcatacaaagcaaacgtttacagagctctggacaaaattgagcgcctatgtgtacatggcaagtgtttttagtgtttgtgtgtttacctgcttgtctgggtgattttgcctttgagagtctggatgagaaatgcatggttaaaggcaattccagacaggaagaaaggcagagaagagggtagaaatgacctctgattcttggggctgagggttcctagagcaaatggcacaatgccacgaggcccgatctatccctatgacggaatctaaggtttcagcaagtatctgctggcttggtcatggcttgctcctcagtttgtaggagactctcccactctcccatctgcgcgctcttatcagtcctgaaaagaacccctggcagccaggagcaggtattcctatcgtccttttcctccctccctcgcctccaccctgttggttttttagattgggctttggaaccaaatttggtgagtgctggcctccaggaaatctggagccctggcgcctaaaccttggtttaggaaagcaggagctattcaggaagcaggggtcctccagggctagagctagcctctcctgccctcgcccacgctgcgccagcacttgtttctccaaagccactaggcaggcgttagcgcgcggtgaggggaggggagaaaaggaaaggggaggggagggaaaaggaggtgggaaggcaaggaggccggcccggtgggggcgggacccgactcgcaaactgttgcatttgctctccacctcccagcgccccctccgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaagtttttccttccagaaatgtcgcctttcggcccagggcagagtcactctgtgttctggggtatctagcggctcctacctgcgcgaacactcagattgcccctgggagagctcagcagggtaaacctagagctctcccgtggactcccggcctgccagaggtttaacctgagctctcctaatttctgctgcgtgccctgggtgctgattcctgccctcccagattcttcaactcccccaaccgccccaaattctcactacctcctggtactcgaggtcccaaacagaaatcctattgcacgggccaccttcagagataaagctcccaagccctccactcttcctttcctcctgtcctcaaagtctgagaacctcaacaggaatttgggcaatttctcctcttcaggtctgttaggatttcactttcagcctgcgcagattagagtcaaaaagaccggcccaatagcttctcagcgggtatcctccagagaggtaaagtgaaattctcggttagggaaagaaagtggtctctgggtgctgaggtctgctgtgtgaaagggtgaacttctttctcctgaagcaactggggacttgctccagggctggaggtcagtagagataatccaaaccgtcatgtttagagtaggcagaggggcaactttcttggtaaagacttcacaggatttgcactcacagtttctcaacgttggttgactatgttgaaagtagttgcttgggtcggttttctcttgtaaagtgtttattttctctgtggattataacagatccacagccccctacttcaggtttgcatcagatctataaagaggagaatattcttttaatgtacaatttaattaggcttgactctgacttacaaaactgttggaaaacatttttttgtaaagcatttcctgctatttcagtgtgctccaaaatctccactggggagggtggagtgaggttttttattatattcctttatttttaggacatgtttgcattttagaatatgtgcagttagctctaacaaattgagtaagaactcttaatgacctatgagccgtaatcttaccccaaagttttaattagcatatgagaaaagtggcaggcaattgcatcgtgcttattaaaaattattcctcaccgcagttgttgagcttcttggagaccatgctgaagattttctcccccagcaaattaagatattagtttatctgctgagggaggacagactgaattggggaattaactcctcaggtaggccaggtgctgatgtccctgtggacttttgtcttattctttgtttctatggctgttttcttttacctgtgacttctccgaaatttctttgttagccttaacatctttgtttggggacttaaatccagcaatttgccttctttcactgatgctttccttcttacaaggtagatagcacagtgttagtaaagaaagaaagaggagggtaggatttcatattatttcgtgggctgttgaagaaacagcttcttaccaggctttacattccattaggtttttaatgtttgacttacaagattttcagagggttcatttgatattgtcaaagtcttttccagttaatttagactcttcatttttgtaatgggtttatgctatgggacaaaaaaagtattcttcattttataagaacaaatttacttggtagggttaattttttttctagggctgtcactagacggtggagcccctcttctactgtaaacttttcttgggggaaaatgtctaaggtgcattttgacctgccatgatactaaacccagacactggaaccttccatcttctgcatgcctcccccacaacttacttacttaacagggaaaaaactgatggttccacatatttgctaaaaaatgtgtgccttcaaagacaaaaccaaaatttttagggaataactatagagagcaaaagttactcccatcaagtagacaacgagcttggtgattttatttcaggtcttaatgaaaaaagcttctttatgaggaaggttatcatatcttggtgcctccttgacagtccgcttaaattaatgacataaactaatgagaatttagcagttcctgcagaaagtacaagtttattttttttttctggtttgtgattgctgcactgaatatgaggagtctagttaaagggacaactggtgttcctgtcttgtgagttgacgaagactttccatttctaggatatagaaaatccttaagccggtttattgaaaattaatcaatttaatcagaatgcaatcaattccaatacaaaagttagtattttctttctttttattgaaaattaatttaatcagaatacaatcaattccaatccaaaagttgatattttcttactttctctttttttccctcattttgtagggatacaatttggtgaaaggcaagagatttcttaagccaaagcaagagtgtcttccctctctgtgttgcatgcattatgtgccatgtttgagctaaaaatctcaaaattgggcaggcttccaatgacctgttgggtccctccctttaccattcatgtgtgtgtttatgtacataattttgtggaggggtttttttaaaccttagtaacatctgcactcactctgtgttcttatacatttacagtgtttctgctgagaggagggaagatgcaaaggtggtctcttttacttaatttagcatgtggtttgaacagaaggaaaaataaaaagtgatggggcttgtgtgcaaccctgatgatattttatggagctgtctgtcttctctctgagatcaaacaggactacaactttgttaattgaccactggctcccttggcaaaagtagggcttcttatattccagcaagcagcacaataatatgacaaaaatttattcttgggagttgggttctaagagagtgcatgccagaattagagtttggggtttagagaaattatccagatgccaaaagaacattttaatttttctcttggtaatttgttctggtctccatagtaggtagtattttagtagtgctttgatattgacaagtcttgctccctttctctattagatttttcaaaataaggcattttattaattcctctttccttctcctctctcctctcagttatcaagcatttttatgactatcttacaagcaacagtttgtcttgtaaagcagaattttcctttgaaaccaagacagattatttctgcccataggcttcaggaaccaatattttggcaagaagcatcttttctttgtggtcagcaaataggtggtgagttctgtctggatcccaacaatcaacacctgaggaccaaatagccacactgggtggcaccccattcggaagtatacacaggaagtagccctcttgcttgttcacagctcaagtcagccaaagattaacactggtgagagatattttcaaagaagtttgcaggcttccaattgcagggtcattttggggtgctttcttgcctgtactaattttatctcatcaagcttccattctttgagctgtaaactttgaaataatatactggatttgctggtacgtttaattttctttgttaagtgttttcattcccatagtaatttttcatctagtgtacatatatgcatttaaaacaaaaattctttggtctccttatgcgtatatgcactgcggcttgtacacgtacaagctacttggtgggattatgtgaactggagttagaaatgtggacaattttattatgattatttttaatggtgatatcaagatcaccagtttcattcggaaccttgcataagcagggagcagaatgcggactgggtgtggcaaagcaagggcttattttatagccaaacctgaaatcacaactctgaaaaataaaaaaaaaaaaaaccaaacaaaaaaatcaagttttgtgagcttggtcagagaaggaaaaggaaatctctccctaccccccacctccaccattttctctttgtctgcagcttcctcaagtgctgcctgtccccgattttcttttattccactcctttcatgtttttgacattgaaatacagactcttctttccacttctcagggtatttttcttattacacctgtggcatgctcctaaagaatttcttttttaaaaaaaatctgtagagtagtagattagattaaccccagtatctctcccttaagactagatgacatgaggggattgcaaaatgaatagctgggtttttttttttttttttttttttaccttgaggttaaagcctggttcaacagttgctgagagagttaactagattgcttgaggacttggcaatttcataaagtattttgtcttatgctgtctctgtctctgtcttgatctctgtctctctctgtctactgtaatgttggctactttctctcagagcctgagagacagctctgagacacttcccaggtctgttcggttcagacctcagtagctggatcacaagcagtacccaatatgcatatgagggtgcgtgctgcaagtgtccggctgggctaatctgcttaagcttcataaaaattaatcatttgaaaacaaagaaagatattaaagaaattattctatctccgacttcccctatcagcattccatcaagttctgggatgttaaattcagagaaagttaaccttatcttaaacacaaagttgacttttaaacaaaattgcttataaagttctgtacagttaccagcattggttgccctttgtcgtacggaagagaattatgaaatctcatatttacatagcattcttccaaaaaaagagacggtgttttccagtttattcactgcattcgtgtaagtgtgagtaggccaggaggggtgcttagtgattacccttttgctaggtaacaaagtagaaagttagattttctatgatatttgtttaccacgtaggggaacctctctagagcaatactcccaagctttttcttcttgaaatttcccacctgacagataatactttagattgttgctcttaaggacttctctcagtagctgctacatagagatgattgtccgtgaattattgcttgcacactcatgggtgatgctactccctctctctcatggcaattcttgctgccaacctgcaggccacaccaggattgagggcagctcatctcgataaatttatagcattaaagtgctgggtcatttgagaatgttgtcaatttaggttacttagtacctaagttttattctttaaataacagctttattgagacgtaatttacaatccatacaattcactcatctaaagtgtacagtttcatgctttttagaatattcagagttgtgcaaccattattgcaatcaattttagaacattttaatcacccccaaaggaaaccctatgcacctttgtgttcatccccctatattccctcagtccttagcaaccaataatctacttctatctatggatgtgcttattctaacattttgtatgaatgaaatcatgtaatatgtggtcttttgtgactagcttctttcacataaaatatgttttcaaggtcatccatgttgaagcacatatcagtacttcactattttttatagcctaataatgttccactatatggatataccacattctatctatccatttatcaggtgatgagcattacggttgtttccaccttttggctattatgaataatactgctgtgaacattcacgtgcaagtttattgtggacatattcagtccacatattttggacattttcagttcttttggatacatacataggattgaaatctctgagtcatatgatacctctgtgtttatccttttgaagaactgtcaaactgttttctaaagtgtctgcactgttttacaatcccatcagcaacctatgggggtccatttcttccacatccttgccaacacttgttattctctgtctttttcattatagctatattagtgggtgtgaagtggtacctcattgtggcttttatttccatttccctaataacaaataatgttcagtatccatgttcttattggccatttgtatatcttcttttttgagaaatatctatttggatcctttgctcagtttttagttgggttttttattattgagttttaagatttttaaaaaatatattctggatacatgtcctttaatagattgtgatttgtagatattttttcacattctgtgagttgtcttttttactttccttttttttctttttacgttcttaatggtatctagattgaagcacaaaaatgtttttaagtttgatgaagtccaattcatctatttattttctgttttggcttatgattttggcgtcgtatctaagaagtctttgcctaatccaagatcacaaagatttacatatgtttccttctaagagttttatagttttcgctatttacatttaggtctttcatcagttttgatgtaatgtttatatatgactgaggtaggggtccaacttcattcttttgcatgtagatattcagttctcacaatattgttgttgaatctttcctcacttaactgtcttggcaccctttgtgtaaaatcagttgaccgtaaatgtgagggtttaattgtggactctcaactatattcagttgatctatatgtttattcctatgccggtaccacgttatcttgattattgtaggtttttagtgagttttgaaattaggaattttgaactcttcaactttggtcttctttttcaagattgctttggctcttgtgggtcccttgaattttcaaatgaattgggataagcttgtcaatttctacgaagaagtcagctaggattctcacaggaactatattaaatctgtaaaccaatttggggagcattgtcatctcaacaacgttaagttattttcatccataaatatgcgatgtcttcccatttatttaggtcttccttttgtcaacaatttttattgttttcagattataagttttgcagttctttttaaaatttattcctaagtgatttattttttgatactataaattgaactgtcttattgattttattttcagattattcgctgccaatgtatggaaatataattgttttgtatattgatcttgtatcctgcaaccttgctgaaaatacctgagttttgaatgcttctgggacttatggggaagagggcttctgctgctgcactgaaagttaaagcttacttcatttcatcctgtatgaaggctgcatggggacattcttctcagttttactcagctataaattcgaactggtaatcccatcccctttcgggatgaataggagagtgtttttaaatgttcatctctttagagaacagcaggaaagaagcctagtaaggtttgggtagtttataatcccttttttagaatttggatttgggaactattagcaaggcagtgagtaataataataatttctatatagaaaactaacatgtagaggtgacaaatgaaatcactagctatattaggcttatgtttaggttatcgtaagcagctaaaatcataattttatgtttttatatgttgtcctttggacaaagtaaattccagtactccttctgatgtgcatttctagatggggaaaggattcatttactctcatataatttaagcttctttttagggatgtactccatagccatgaagcaaagataaaattcatctatacacagactgaactttgtcttcattaacactctaggctaagggtcatagctaatcagctacaactgtaatgtcctgataattgtgaattaactgcagggcacccagcaaaaggtttagttataatctaatagctgtctgtagagattagcctaataaagggattttttaaaaaagaatctggccgggcatggtggctcaatcctgtaatcccagcactttgggaggccgaggtgggtggatcacctgagatcgggagtccaagaccagcctggccaacatggtgaaaccccatgtctactaaaaatacaaaaattatccaggcgttttggtgagcacccacaatcccagctacttgtgaggctgaggcaggaggatcacttaagcctaagaggcagaggttgcagtgagccgagatcatgccactgcactccaggctccgtcaaaaaaaaaaaaaaaaaagaatctatcaatcaaccacttttcattaagcacctgctatgtgcccagcatgtgctaggaagagataaggtgaaaggggacacaattcagacagaatcttcttgaggtaactgcttacgaggagcttatagccactaaaaacaaaaacaaacaaaaaccaaacaaccaaaaaccaaacagaaatgcagtatcatcatgccatgatgcctgtatgagatcctggattgtacggtatggatttcttaaaatgtagatattttaaaaaaaaagaggaatgaatcaatagaggctgaagtggtcagcaatgttacctgtggctgcttttaatccttcgtggaagtaagtaggagcatgtctaaactcaagcaatagattaaagatcttgatgtatattttaaataacagaagttagtaccactggaaagaatgaactggaggaatgggttgaaatctatttctgcttattcaatagtgcaccccagtcaagttagttgccaatttcttcttcagtttctttggctatatcattgcacttggtgggtacatgtttatgatgtctttatctgaacaagtcagcaataatatgagtaataaattaaaattgaaggtgattaatggctctgaatttgacataagagttgttttcctgccttctaagtttccattgatcctgatgaattgcacaaaccaaacaattcggggagtaagggggcacatgatgatcttataagagctttgctgtattagacaacgtaacattctgaaatggcctaccacctaacatgggctctgttctctgcaggttgagtaggttccttgcttgtggaactgtagtcccgctatttggccgctagggggactgcaagtgccccgtggcaggatttccctgggaatggtgagcctccattgatggtttcaacacacagccaaggccctatcgcaggataacttgaaccagaactgcctagcaccagacaataaataagctactatggtacttactgtttcatttgggatgttgtttctcgaagtggcaagcattttttagtaatattttgactttttaatacctttctttgcatatggagcagaaaacagtgacactggatatattcaagtagcactgtccagtttatagagaagtttcatattccattattgcatttcattcttgtttctaccttttacaagtaactagagtttggagtattataatagtattcatactattacagtactattattcccattataaaaattgtgcaaagagtggttaagttacatgtttacaatcaaacagcttcaaagtgactgatctggaatttcagtcccattctttcttctccagatcatgtgttccctgcttttatctcacagctctttttaccttatagatgggaaacatgagagtcagagaggcaaaagaaccacaagtggtatcaatactagaaatttatgaatttcttaaggcttctaggtttgttacccatccaccagactgatggatttggttgtgtgagagttctgggtgccaataaccttgccattctactttacagactgcatatattcaataaatgcttattaagcatctactatatgccaaattctgtactaggcaccaatgatgtagtggtgaacagaacagacaaaaatctcttcgtggagcagacagtttaatgagaggagacatgtagtgtacatctgagcatgaaaagtgccatgcagaataacttcacagagtgtagggtatagagattgatggtgagagggaatattttatatttgctggccagggaaaaccttactggaaaagtaaattttgagtagtgacctgaaggaaattaggaaatgagctgctatttggacatctggagttagaatattccaggcccagggaaccacaggcgcaaagggcctgaggcaggagcacacttgctgtgatggaggacaaagaggcccatatggctggtttaaataagtgaaggatggtagacaatgagatcagagttaatgaggttgcatggtaggtcttccttaggactttgaattttactcctaagcaggttgtattggacggttttgagcagggtaacatgacctgacttacattttaacaggctccctcctcttcataacatctgtcactctgatatattatacgtttgtttgtttacttactgtatgtggggggaagagactgtgggagcaaggggggaagcagggaaacaagtacactgcagtgatctgggtgagaggtgaccgtgtctcagactaaggtggtattggtggagaaggtaggaagtggctgaattctggatgagttttgatggtatagccaacagcatttactgacagattggatattcactgtgaaaaaaatagagatgaggatgattgccaagtttttggtctgagtaactggaaaaatgagattgccatttactgaaatggtgaagactgtatgtagagcaggtgcatgggcagggtagaaatcaagagtttgatttttgacttataaagtttgaattatctgatgaacatcctgatggcttcttctcagttagttctcatgcagtgccttcagctttgctgttcttcaagaaaattaaaaaggaacttagagatcgcctaggctgtaggtaccctctcccctctttccttttactttatagaggtctatagaagggtagggacttatccaaggtgaaacagtgagctggcgacagaactagggcacaaacccagttctcttgaattctgaatcagtagattttctttttttagtgtgattctgaggactcatttgggcaagagtgagttttttgttattgttttttgtttgtttctttgcccaaacctaaaaccaggtaattaaactaaatagtgaataaaactgggaaactatacaaattggttgctctccccaatcacactgaaatattattatttttactgaaccacataccaaaatatttttcctgtaaaaacacagtaagtgaacttttaaaggcaattgagcttttaacaaagctagaatctacagaggacctggacagaaatggccttaaatcctaggaaattagagttcatggaacctgggagaccatcttgtccagctagctcattttatgggtgaggtgcctgaggcaccaagatggaaagggacctggctaagctcatacagcaagctagtgcctgagcctagtcagagcctgttttaagggttagtcgtatgttgttttcttgaaaaaagttacattggaaaagtgaaaattctttggtccatactgagaacaaagaattatacataatcatatataataataatgatagcacttcctgaatgtttgctgtgtaaactttggcaccttgcatgaattgattcatttaattctcatgtcaactttaggaagcaggcctagagaggttaaggaacatgtccaagggtcacacagctaggaagtagcagaacttgtgtgcactcccaggaagtctggcttctaaccacaaggttctaactactgtgcaataccaggagcttctcagattacccttcacctttaccaacccaaatgactggtgacgtaggtgacttcattatgctctgcccctattatagtccactgatcctcaccaaataggtgggtggcctagaggttaaagtagaggcagagtgatggaaaggggtggttagaagaagttgatgactcatgatagggattggaaaacaggactacaggaattattgaaaagggcctagagatcccaaggaggttgatctccgactgctacaaacctgggcaattcaatgcctgcttaaataggagagttaagataagaaaaataaaattgccaatttttacagtcagacattgttttatttattttacatgtattaattcatttaatcctcaaaatactccatgaggtagctacaattatcatttctatgttgtagatgaagaaacaggcacagagcaattaaataacatgcacaagattagagaacaagtaagtggaagtgccaatattagaatctaggtagttcagctccacaacttatgttattttccactatatttatggaatgaggtaattttcttataacagaaagtttttaaaatgcaaaaacattgtgcctgaacttcaaacactgaacaactcatatccttaatatgcaccagtttcttttaagcactcttagaaggaaggatacttaacctaatgtcacatggtgagtaagtagcagaaccggaacttgaatttgagactccggactgccagacctctttccactctatcacttgggctcccttctaacattgacttgtctccctccattcctcctccgtattgttctgcccttcaccttttaattacctgtctccatcaacaagattggacagagaattgggagagtgagcagagtccatttccttccagagactggacaaaaggaacaaaatgttaggaaaaaatgtcagcatgtgggatttgtgggatttacactaaataagaagggacacttcccaggactgacaagatgctacctccgtccctctaggccccaatgtgttgtgcaggatcccataggaagtcatgaatgtggttgtcagataacctttttgttactgtggaaatggaagcaggctactgcaaaaatctgtctctccaggttttcttttaaagaaggtagtcttgctaaatgataactatttcagcatttatttgaaaatgggcagtgcaggagagaaagaatttttccaagcttgtcacattgggccacctctctgaagcattgtccaacttctaattagatgaggagactgcataaaccaagagttgagagtaaagatggaaacacttgatgtttggtgtttgggtgcagaaaggattccagaacatgttttgggtctctttactctgtccatccctccttccctttcatctttgtttaaaaaccacagttagcaaatgtgtagtctgtttgcaattgttcatctgaaaaatttgtttgatcagccttttgaataaaaaagaccaaattagactgagatatttcagtcaccaactatctaataatagaccaaaaattttaaccatgctcatactttcatatggtatgtagtttgctttagacattttctgggcttcagtgaggtgctagattgactcaaaatatggcaggtcagatgtgggattgagcagggtggactcttctctacccttcccaattcagagttccccatcaaagatgatctcatagtgtttgaaaaaccaagctgaaggctttgggaattagggtgctgaagggatatgctgtttcccaaagccttctcagtcattccttctccccccagttcagattcttaacacctctttccaggattagtgcagtgatcccacgtcctttctctctagctctctctgctactctctaattcctattgtatttgtgccaccagatctttccaaagtttagctccaatcttgtctgtatactgctttaaatgtctattagtctttaagctccttaagggtgggagtcctgtcttattttttccctattcttcgtgcttaatgcaaaggaagccttgctgtatagttgtgtaatgcatgattacaatttcagcttctccccattggcttatgggttaaagtccaaattatttaaatctggtgttcaagtccttttatgatctgcttatttttccagcctgaattcctggagttcccttacaaaactcttaaaacccagccaaaaggatctagtcactgtcactttaaaccatcctcactctcttgttttttgaacatgttatttttcttataatccctttgaccttgaaggctatcccaatttcaatactatccattcttctatgacagccccctacaaaatgaatattctcaacctcccaacccaaggagaagtgatctatatgacacaatatggttgaaagaatgttggcttcacttctttatctgtaaaccaggggctagaaatctctagtttataagattttgtggagaggggatcatatgtgattatggatgttaggcacaagtcaagagtgcataagaccttttggatttatcccttttttctttctccatcaatatggtacttagtcccttaaatcagaagtacttgtgttaatgtctgataacgtccttctaaatatacctctaaacatctgtctctctttagggcaaaggttggatatatctgcaaagattctctttggatataagatatccacagcacataacttaacagtggtgtacacagtaggtattccataagtatttctttatgaaatgattcagagtcaatagtagtaagtaactgccaaaaacaactgatggattgtaagttccattaacataaatacagtcagccctccatatccatggattccatatccacagatttaagcaactgcagatggaaaatatattttagagacacagtaaaaataacaattcgacagtaaaaaaatacaaataaaattatgtaaaacaactatttacataacattgtattagctattacaagtaatctagatataaatgaaatatatgggggatgtatataggttaaatacaaatatgacaccattttatatgttttagttaaggaacatgaatatttttggattttggtattcatgggagtgggggaatggaaccatgccccttcaaataccaagggactattatatgggacacagaataaaggagttgattgtcttgctctgttaaattctggtcagacacatttgcaatgtattgttcagccccagtattcatggagcatctccttttgtaaagcatggaggagctgtgagagagacatggagcagtgaacataactattgtttcaacgtacctgaaggattatcatggaataaagaagttagatgtttttctgtagtaccccaaagggcaaaagcaatgaggacagattacagttcagtaaacgaaagaggtttttttttttttttttttttttttttgagatgggagtcttcactcttgtcgcccaggctggagtgcaatggcgcaatcttggctcactgcaacctcgcctcccgggttcaagtgattctcctgccttagcctctggagtagctgggattacaggtgtataccaccactcctgggtaattttatttattatttatttatttctttatttattttagtagagacggagatttcatcatgttggccaagctggtctcaaactcctgactgcaggtgatccgcctgcctcggcctcccaaattgttgagattacaggcgtgaatcaatgtgcccagcctgaaagatattttcttagaatagcttctttcacccttcatcagaagttgtcaacatggaccatatgagttttgtttggtctatatggtgtatatgtgtgtgtgtgtgtgtgtgtgtgtgtgtgtgtgtgtgtatgtgtgtgtgtttattgaattacttgctaacattttacttcaaaattcagatttccaccatagggaatgaagatctggcaatacaggactttcattcctacatggtaatgaccagctgtaggtgaaaagcagctgatcctctggatgggccatgcactttgcagtttgcccaggcagcactgatccgctttattcatttaagttacctgcttgactcttctagtcattcgagtatgtcatccccatcagatcagagacctaagcaaatcttgggtcccttgcttactccaagggctttcactcctcgtataggaggagctaaagaaatgtacaagcagcaccacaataggatcagacctggctttcaattctagcacggccacataacatagttggatgacctcaggacagtaacataacccctctgagcctctagatcttcattatctgtagagcactcttcttatagagttattataagaatgaaataaaacaactaggataaagggcatggcacttagtaggtgctgaaatattagttcccttcttctaattcaccacaccatatctgtctatctattggctgaatcacataaatagtaaattcacattcactgaagacattcaagaagagtctggaccctttgggaaccatgtatagggcaaaggtttgaactcatagtagatgatttttacagtcactttttaacaatttaaaagcctatagatgactccaaaatgcccatttggatgatatgaggcatactttgtgtagttaaggattttaaatacataacagagaggctgaagggccttcgggaaagaagctggggtaagagtcaaagtgtagtatgttgaccgatgttcaggaataggctttggcatctgacagattttgttttaaatactggctctgggtcttactagcttccagttctgggctgcttcacctctcttgagtttcagtttcttcatttctaaaatgaagatactaatgcttcctttgttgggtttttgtgaatataagtgagataataaatgtaaatatctagcccagggcctggtgcatagtacaagcttcataaattgtacctattattattagtagtagtagtagtccagacaaacagagcttgggaaaacgctagactctggctgacatacatgggcttttccccaggccactgctgcctggcttccccttccacaaagctttgagtctccaaaatgctttggctggaatgtaagcgtgaggtcattgcagataacaggggagcatgatttgcttcggtaatgcaagttattaagttacttccctcagcccagctgaaatctcttattggttgatgtgtgcttcaaagtgtgagacagagctagtctgaggagagagggagagtgagaagattcctcttcttggccagaggtcatggtcttccacaaggaacagaatgactcaatgcaaattatgggacctctttgagtttggggcccctacatttaaactagtaactccgttgcacatattggcacccttcccccaacaaaattactgggcaggaattttcttgaatccttccgtggcctggaatgatctcccttctcatccttgtgatccacacagctggcaaatggcaggcagcagaacaaaaacaagcctcttagcatatagggagagaaagagtcacagcagtactgaatttgcttgggaacctaatgttaacaaaggaccttcctctcaacaccccaaacagattaaaacatttttttaacagcaagttgtgtctcggagcagctctttgcttgggtatatttaaagatctgctgagtcatttaagagcaggctggcatatcctaagaggcaaggactataccccagtctatgggggagtaagttgagaggtgaaatctgtttggctttctcccatggaaacaaacaaggtgatccacttccatctcccacgactctggagagcatctactaagccttcttattctatcaactttgaactcctcagtgtataatagagtaagggtgagagggaaggagcagtcgtaccagtgtcattattggtatgttcaggagttcaatttcttcctgattcagtcttggcgggatgtatttgtttgggaatttatccattttttctagatttttctagtttgtgtgcatagaggtgttcataataccttctgatagttatttttatttctgtggtgtcagtggtaataacccctgctgtctgaaattgtaatggccctgctattggtagctgagagtagcatggaagtgtcaggttgatgggttcatttaattcttttcttttcagtttcagtcacatgcattgttaccatggcatatgacagttgctagaaagtgaaataattttttttctactttattctccactgcacttctaaatttattagtggagaaattagcagttaccaactgttcattataggtacacattggggtttccttagagccaattttccccctggttttcatcttgtaaatctgtaatcctaaaaattagcaaaacctagagcttctctttggtcctggcctgtttgaaccctgttccacagaccccaatcttctttcttgtttgaggcaactatccttctctttgcccaccgccattttccttcatctacttttcccttctctagcacctcagactgtcttcccacagtggcacagcctcccactccactttcactgtgccatctccttgccatcaaaaccatcctcacagacccttctgaaaccacttctaggaagggaaatcacaatggatccatgaaggatgctttctggatgactttaaaagattggtattaagatattttatcagtggtagcaacactgacttattcaggcagccatgccccggatctataagaaatcaggtaagctaaaagttgcttgagctggcaggagacctagttctcttttttcctttccctcttgcattttgtttatcgatggttttcaaaggacttagaggctggctttgttatagttagttggtaagagaaatggtggaggaccggaaaatgggagtggaacgaatgagcatgtttgagactaagttattacaattcctaggatgtataaattgcttgaaatctaccaagtactttcagacacattatcttttttactcttcaaaatcaacttggaggtaggcacaacagggatcaaatccttagttcacagatgagtaaactgagactggaggaaattaaaggagattccaaggtaactcagacaataagcaacagaaccaggatttggtgaattttttggggggtgggaggtacagagtctcactcaggctggagtgcagtggcaaggtctcgtctcactgcaacctctgcctcctgagttcaagtgattctcgtgcctcaacctcctgagtagctgggattacagacatgtgctacaatgcctggctaatttttgtatttttagtagagatgaggttttgtcatgttgcccaggccggtcctgaattcttggtctcaagtgatccacctccattggccttccaaagtgcagggattataagcatgagccactgctcccagccccagaccattaatttttgacagtaagtccaacttttttcaagttcacagctcagatttgctattgaatgaatgagtatatatgtcatttgggaacattctttccaacttttggttgaagatttgttttatcacttgtgaaaattttttttcattcttagcaatgtcagtttagttaaatgagcatttcatttgcgaattcactaattaattattttattcatcaatacatttcctgagtaccaactttctatcaaaccctgtgctggattctgaggctacaaagagaaataagataccatctcaggcctctaaaatctcacagactggggactgacatctcagtagtaaacatatgaacagcaacttgtgaaacgccattagcaaaatctcaagttatattcttcagtgactatggccatcctaaaaatggggtgtcttttatttggggtaaatgaagatgaagccttatgagaaattgcattttaatctaatcttgtcttgctaagaacagaagtggaatgtttcagcctctgtgtgtgtatttgtgtgtgtgaaggttgagtgtgtgatgatggatggggctgcgagattgttaagtaggatctatggggggccttaaatggtcctggtgagtcccaactttctggttatgtatttgagtagagtatgggggtgacaaagattgttgtttaagagttgattttagattttttccaagtaaatggtcagctgacttggagcatcatcattccacttgctttgaaaacctgccacttaaggctccttccagtcataggttaactctttctggtcaagtattactctttttgagcatttacctgtcagtgacaggtacaatgttagatgttgtctctctgttttcttgtttaatctttactttgatcctaggtagctcttattagttccactttataggtaagaaactgaatttcagagacttgaatgacttgttcaagatcacatagtatagtaacttggtagtttgggacttgaattttgattgttcagttttttgtttgtttgtttcctggcctccctgctgttttcactattccacaccacttcagctttatttttcatagaggccattaaatgtaccctccatcagccaaagcctcttgcctcccttcaacgtaactcttctctagcgtcctcttaataatcttctgaaaaggttttacagcctttctgggtactgggacccagagtcttaatccaggctcttaagtgccttatttaactgtaatatggaaaatcaaagtcacagctaattcaggaaaaatgagtttgggatgtgaatttcctaggcaacttgtcatctcttttttacttccttagcttcataaacttacccacaatgttccctgaggactaagagtaatggagggtgatgaggaaaggctttcctcccttcctttccgagagtcctttagccaaatgccacacctcctcctgtttccctagtctccgtgcagagatggaagtgggagatagacatgggttcctttcagccctgagttcatgccagggttttctttccctctagctggactgaggtaggaggagaggttgaagtccaccaataagaccatgagtgaagaagactaaagtacttgaaagagcagcagacctacgcttaaaatactagggtttgtgtccagactttgtgggttactatctgtataattttgggcaagtcaacagttctgagtcagagttcccttatcagcagattggaagataaattctaattatatagatgaaacattaagtctagaagtaatttgtaaattcagaaagggcttatagatttaaagtgtagccgttttgattaccacaaactaaatcctatacttcagggataaaatcttctcctgttttttctaaaagcctgtgcatgtgtggtgtaaggggtgggttttcccttgtaccagcaacttagcaattgtagtaacggggctgagggcagtggcatgcttcttcattgagcaagtgtgaaaagagggttatgcattcaggggtcagcagatggcaggcagagtagcccctccaaatctccctcccataccacaaagccctcttatttattcaaacttaacattagaagctcatttcaagtaggcacgtctgtgtctgggcgtctattttccttctttgtatatagcaggcatttgtcaacttggtgaaaagcattactcttctttccatttctgaggactaattgtgcttcttcgctagacacgagttcaaaacagtgggttgaaagagggcaagtttatgccaaagaatcagaaatagtcataatttagagagaattctagaggtcagttccctttcgtatggactgggcaactgaaacccagacagggaagggaattagaccaagttcacaagcacaaacactttactggcacattcagattggaaatcgagggcttctgctcccaggtcagaactaaatgccctttctagctagggtgttctttgatctcagtgattttgactctttctactgcactctggggacagtgggttctgcggtaccaactccaattaaagtgggaatatgtaccagcccctccccttggtttttatttttcagaggcctggcagtcagagggattctgatctctatatgcaatattttcacactactgtacttattgaaatcacatttgaatcttggcaattaacaaggcagtaattggcatcaggagggtatgttagtttgcttatctgcgccgtccctcctcttcccaacccactgtgtattgcagaatgttttatcagctctgatttgccaagttgctctcttctccagtaggtgctgcgagcagagagggattcctcggaggtcatctgttccatcttcttgcctatgcaaatgcctgcctgaagctgctggaggctggctttgtaccggactttgtacagggaaccagggaaacgaatgcagagtgctcctgacattgcctgtcactttttcccatgatactctggcttcacaggtgggaggttcttcaattgaaaacttagaactcagtttctagggtagtgagtgttgtaaggtttggactgtgacctaatattacgcagccatgacattatctattaggcatctagactagcttgcttgaatatcttagcatgttgactaatttggggcagaatatagtgtgggtgggggattttgtgtgtgggggggggttgggggttgagcaattcattattattaaaatgcaaaaagcacttaattcgctatgataagattgcctttttcatgcatactggcctacctgcaagacccctagagacagtaagcagcatacatggtgtcttccagttttcagcctttgtgcaaggaacaactgtgggtttctgcacatgtgttgtggtttgatgtttgtatgtgattgtgtaccagggtatgtgtgtctgttattgtgagttcatttctgagcagttgtgacacacagagatccagaaacagtgtcttaccctgtgtgctttgctagtgggaacgtgtcttttcttttgtgctcgtatctctgtgtaatcgagtgtcttgctaagtcaatgtgcctctgtctctttttaccagttctgtctttgtgtctctgtgccttcatgtattttttcccctgagtttgcacgtctctgtctatgtggatatctctcactccaggccactgtatcactgtgtctgtattacagctgtttatttctgtcggtgtgtggatttctatgtctgttttcatcttaatttgtgtgtctaagcaagactgttttggggtgactatttcagtttatgtcatagccattctttgtgtgactgcttctaggtatgtctttttctatgcccctattgtccccatctccatgtgtctctgtgtgtatatgttctaatgtatctgcctacttatcttagtttgtatttctctgggtgtatatccctctcttgcagttctgggcctttgcagtttttggcttatgtttttgtatatatccactagaattggcttcttatcttttttgtgcatgttttagtttgtatgagtgagcatatccaactctgtctttgagaagcagaactgtctgtgtttgcagtcagttgtgttggctgtccctgtgtttgtccctgtgtgtgcatttcattgtatgtgtacgcatccatgtatctttctgcttctctgtgaccagatatttctgtgtagctgtctatgtatattggcttctgtctgtgtctgtgttgttggctctacgtctgtgcatatgcacccaccgggttcataaaaagctcacctgctctccaaggaatctaccagattattttgtgaaataactcacgtttcgtttttttacttgccagctgctatggtacttaaaagtgtgttggtacgtaggtgtgcataatttattcatgtaggatgtcaaaagagtcagttaaaaattatgcacagtgtgtctttattaacaggacacttgtgtgtagagaatccttgagaaatgagtggttagatgataaatcttttcatattaatttcatgatgtcagtgaagtaaatttgcaagatatgggctgcataagaactatgttctttttaaaactcagcatattgatggtggagaaagcatttatttgtactgcaaagtcttatttctgataagacatcacaaataagaattattgtgatgagacttatcacaaataagaattattgtgataattcttatttgtgataagaattactgggttagaaggtgttacttttctggttttgtttgggtttttgttttgaagtgttactacagatggtgtcttagggacaaagagctctgaggttgacttagaacacatggagtacagataaaaaggagaatgaaaagtaacagagagatgggcatattccttgtttgaatggagtcatccaggggctcaggatggagtgcacaggaaatggagaggtgaaggtcatagagagaagtttagcaggaccagatctttccttgtcctgggctgctgtgaccatataaggaaggcagtaaggggaggggtagggatgaggaagagaccagctctcctctttctttctgatggaaggttaccacctctatttaaaacttctgttcttttggtttctctttctttctttgattatattattttctggacttgttctgccaaagcaagaaggaaattccacatgtggctcactcatttattatacttgtttctttgcacgatattaaagacagcttgttaagtgtcactgcaaacatcatacacactgatccactgatatgggcagggggttctttatgccagttctgctctcttcccagtgtatctgtggtgcttaatgggcgcaaccatgatttttctgatgtcagtctgtgatgtcagttgtccagtgtgtatgcaggctgcttaagagtacatacagttccttcacaattatggtagtccctgagaaggaagtggtcattaataaaagactaggttcagtagaaacatgtaagttgtctaggtgttggaaattaatacagtactgtgctaagggaacatatatctagaagttaactgaattatgctcaataaaaagagtacaaatgtttcataaatattttgacctaatcctcctgtaagattaggagagggatatttccgatattcaaataatttttttaattggcaaacaccttagacatactatttacataaaattgacatgacaaaattaagtcattgtgtctgttttatgataaaacaggctcttttgatttagttagaattattgaatgtaaaataatgaaaattaaaaaaaaaacaaggaggaggaatctatcctattttataattcagaccgttgaattgagtttttcttttgttgtattgatttaaatgcagagaagtctatgatgctggattccagtcagaagataaacatttgtatgtgggctctacattgcagccaaccttgataatttcaaacctcgattttctcatctgtataatggtaataataaagcctgtctcagtagctaccaaatgattgcatatgacaaacttctcacttatttaagggaaaaaataagaaaaagaaggacaatagggtggatttttcatatagtaaaatttattcagttagggtaatattctgagattgtcttctgaagcaaaccctgcaaaccctggccattctgttttgtttaggaaagaattcatcagttctgattctgccttttctggggagggaggctgagtattggattgaagaggagtcactacttttctgagatgatatatccgtggtaaaaattattaatgctttgcacatgcaacatagagtgttcaattttgttagtcaacaaatatttaagtggcagctgttatgacctcaggggtgtagtgacttccttattgtcctttaattattaaaaaagaaatctatatcagaatatcaggtaaactcttattacatcaaatattataataaagatactttttatattctctaaacaaagtagagatctcagatgttggttcatttatcaatataatattagatttgaaaattccagtatacaaaaggaaaaggacagcttcttaaagtttatagtgattttctatgaactatcaattccgtttttttctgttttactggtatgatggaaactaaatttcgagttgtaagtagtagataattagactgcagggtaagccttgagattacttcttttcaggtaggaaactctactgtgtatttggctagttcaacctatcatgggtagtcaaaaatagttacatatacaagtcagcattttttaaattgttcagttgtgcttaagattggtcctttccaggaacaatccagctttatcaaaaaattattgcgtacatgtaaagtgttctgacattttaatgctcacaatagccgaatgacgtgggtaagaatcttcgtcttcattttatagatgaagaaatgaagacacagagacataaattaactgggccagggtcctaccactagaatgtgatagatgataatttgagctcagcacatagttatttccctataatatttgttttatgattgtatagatgtctgctgaccaaccttaatctctgctccctaagattaaccattctacaaagcagaaactggaggtcattcaaatgaaagctctacacttttagagggccattaacaatgctcaagttaaagaaaagcaatcaaagacaactaaaatactggtaccttcaaacagtacttatgaattatttaaccttagataatttggctttgagttagaaagatagagtaagatggaggaaccaattcttccctgggttgatatttatttatcttgctcttttgaagtctaggccaatcatcctatttattctgaatggcccgttaacgtttatccatttagggacagcaggtttggcacaaatggattggttttctgaggtcttatgtagagggctgcactgactgacttctgaaagtcccccctaacccttcaaatctcagggtcatctggtctcaagccttcaattatgaatacatttctattgcctttttgagtaacagcacaacactgcaagctgacccactgggtggatggaatggggctcttgccctaccaccctttggcaaacaatttgagggtggcattgtcactacctcattgtatatagggtctcttgaggcccagaatggcaaaataattttcccagtgtcacacagcgagttattgtcagagtaaatatcaattttgaatttgtagaccacgtggttttacctcatcatttctgtttgttatgaaagttttacaaataattagaagtagaaataatgattaaaataaagcataactactaaaaaatagtttattgcagcaccacctaaattcatctcaccactctaccagtagcatacatttcacaattgggttaacattgctctggatcttatagctgttgaagaagacaaaattctttccattctccagcttatattttccccatttgtaaaacataatggaagtgtacggaaaataggagttgataatttttaaggcccttgccagcacattagtacataggattcttgcaagtggtggtttacttcacttcaactatagaaggcctatgcgacaccacccatagagggtagtttgaaagaaaatgctagtgactacgtgtgtttccttcctgacatattttatagaaggtgatgagttccagcattttttcagacttggatctggctttcattccccttctcctcccaccctctaaaacaacagaggcagcaaccatttacacactttccagaagtaagtaagtaagactgtattccagaaacaccctatatcaaaatggaaatatactcaagtgccccaatgacccattgggctagtttgaacgtgtgcagtctctgtgctccccgttttagcttaagcctactccctaacctgtcatatgtcacccagccatggagcctagggcaatgactgccatcatatctgactttatggcctctcagctttcaatgactagctttgtagcagaagtttagcctctcatccccataactttggaagtagtgttgagataaagaaacgttgaattgaaggttgtgttttctagatttctttcaattgctccttaggctttagaagataaattctcctaaaagagaggtgctacaattaatccaagcaaagggaaagatgtcagtaaaactgccccttttcatagaggtgtggcaactgctgggaaggaagaaattagcctgaggccatgtgattactaataaactcaaagcggcatttttttacttctcaatatgaggttgaaactataagcttaaattgctgactttctggcagcaccaaacagtaaggaaaccacaaagataaacccaaataatagagccaattttctttttttccgggggggatgacttctaactagtgatatgaggaaggataagaaaatgtttctttgtaggacatatgatctttgctaagtgcactgaatgtatgtagaggagacaagtctgctgagggtatgagaattgggccaagatttaacacattttcaaagctccatgaagaagcctactgagcagtgggagtggagcaggttggggatagtgaagtatttgtaattcatttttaaaaaggagagggagagagaaaaggaaaaactgggccacccatcctttgaaaagaaaccttgaaagaggtccaaatatccttagaaatccttgacttcttaaaagtgatgtttgttttttccccctgacaattatagaggtcagagagtttttcttttctattacaaaacattgagagtgtgtagaaataattgtaggtagcttagccttggctgtagtcagaacttttgtactgtgactttaggatctgtatggaatcgtatgatatgcggatacaccaaaaactctatgggttatcaaaatgggatagcattaaaagaaatagtgcttttgtttagaagaagaaatgaaatgcttgtgtccagatgcttaaaggaaggcagtgcagactttcagaaactagactttaagagctgtactcagatactgagaagggctgatggctgaaggaggaacaatttaaaagaataaccgtctctcctctccctgtatattggacataaaagaatatcccattcttttcagaaatgtaatacaacagtttagcttgctagtaacttcacatgctatttcctttacctcttatatttgaggtgtctatttggagtgggctgtgtttctagctattctgtttatctggtttgtttttgttggtgtaggaaactggtataaattttatttgggtaaatatcacctcaattttcaactaaagctttatttaagtttcacatgaaaaagacaaatgaggcaaaggaagagaaaaatgcattgtcagaatcagaattatgagaaaaaaagtcaaacaaacatatttgaaatgtccagaaaacctgtgagtttttatgtatactatacaggaaagatattctgtcatctggttgccaaactatggagggtgggagacttcgaatttttgtcaaaaagtattctttcattagaaagatacatgggtgtgcttccatgtcagcaacatgactgcagaccaggaagtcctcacggagagctggaatatgggtattttggactctctggttagatgcagcttttacttcacatcctcagtggtactactgtaaattttcattttcctgtggaataccctatttggttccattgtatatagttgacaactagaattcgttcgctgttgcttgagcccaactataacttcttggcactatacctatcttctgatgtgcctgtggaagagctaccataatgaatgtgtacatggacaaaaaaaaagagagagagagagagaattaaatcatgagtttgtgccttgggagctacagtttaaacatttgctgtttttctcacttaatgaaaaatttatttgaaaataacagcacagaaaggaagaaagacaggctggcaagcatcctcctcctaatacacttatccacgtttggataccttggtctcagcctcagaggtcatatttttagtaaaatggccaccagaaataaaggattttattttccagactttggtgtttggagctggtgtgctgagagctagcagagaaagccctactcaggtagatgtaccagagcaggatggttgctggtggatatggtggaataccttttatgtggttatctcctccttgtaactcttggctgcataacccttattttcttttctatttttattctctctcttggaaaaaaaattggtggtaaattttcatgtgagccatattgtctttttaaatagttttattaatataaaatgtacgtaccataaagcatacccatttaaactgtaaatgtcaatgggtttctctctctctctctctttttttttttttttttggatgctcagagttgtgcaacaattatcaaaatcaattttggaacaatttcattgccccaaaaggaaaccctctgcccattagcagttactccccatttcccccaccccctgacccttcaaccctaggcaagcacaaatgtactttctgtctctatagatttagccattctggacatttcatgtaaacagaatcatgcaatatgtcaccctttgtatctggcttctttcacttagcatgatgtttccaaggttcatctgcattgtagcatctgccaatacttcattccttatttatggctgaataatattccattgtattaatgtatcatatttgttttttccaatcatcagttgatggacatttgggttgttttcatcctttttttagctattttaaataatgctgctatgaacgttcgtgtacaagtttttgtatgaacatctgtttttatttctccttggtatacacctaggagtggaattgctgggtaatatggtagcttaacatttaatcttttgaggaactgccagatttttccaaagcagcagaatcattttacattttgaccagaagtatatgagagttttagtttctccacatcctcaacaacactcattattgtcattgtccttttcagcttttttgataatagtaatctcaatgggtgtgaattgggaccccatcatgcttttgatttgcatttccttgaagagtaaggatattgatcatcttttcatgtgcttattggccgtttgtatattttttgatcctttgctcatttccaaattgggttatttgtctttgcattattgagttgtaagatcttacaatatattttggatgtttgtcattttagggatgatacttcacagttatatgatgttttctagcaagcatttgcgttgttctactggtgttacatatcttagctgcattagccactttgctgggtatgaatgccagcagaatctaagtgaccttggcttcactactgagaatgcaacccaagaacagaaatttgtcagaaatttagcactgaagccccccacttcccaaacttatctgggacaaggagaatctacatttaaagctctatactttgtgttgtgttttttttactttagcttggttggatttaggatcttttctttttgttttgccttatgcatacctaagcagaggcaagggaggaaagggatatgaacctggtagaaaagtaagtaagctttattcagattggcatatccatcttaatatggttcaattggctgaagaagtatctcaactaaaactctggaatactttgaagtaccagcaatatgtaccaaatgtactttttatttatgtttggtctctatgtacttgtgtgtgaaacaatgagcacaaataataccctccttgtttttaagcaatttatattggtgatttaaaaataaaataaactcaagtgggaaatcatgaaaccccatgtaaaaacaataagagcatgttttaaaatcccacagactttagtttcaaatagtggttttgctatttcttagctgtgtgtcactgtgcaagttactttgtttctctgagtctttattggtgatatatgtaaaaacccaccttctcaaattattgtgaggacaaaatgaagtaattaacataaagttcctggtgtataataagtgttcatattttgtatttgagcacagggcaactgggtttttgaaactgcacattactgttgcagtcaaatctggcatgaaattagtgcatagacagaatgggctgggaaaatgaaaggactttgaacatttatattctgctttatttaggcataagtgcttaataattattgatagtttcttctggttatctgacattttgaagatactattacctagcagaaatttcttgtaataataatctcttacacttatatactgttttgtgcctttagaagtacttaatgctctttatttcactatctgttcataaacattctctgaagcaagcatacagtcagtatgaattccatttttcagatgagacagctgaggctgaaagacatagagttacttgtctcaattcacaaagtaaagtgccagagtttgaaccagagcccaggtcttctctctcaacgtagctctttttctccttcattatatcaggcatagtagcaacgtattcttttactagctttttatcttgaatatccttttagcgacttgcctttggtgttagtgtgcctataacattgtcgttgaatatcttaatacatttagtggtcttggcaagcagttttgtcttcagaaggacactgaaatctgtggaaaggactgcagaagattgggtgggcagacacctatcactttcggggctggtagactttctattgaagcaatttgcaaggctactttgtattgtctaaaagcactacttcagaaaagggttgtgatgtcaaaataggcactttgagtgaagaaagggctgtaagcatgggtggaaaatgtggtagatgattgtcttgagttattttctttaatgtcaaacaggcagtccttggaatgctacttcaaaaagtgttgtataatgttgaagatacagttacagatttccaacacgaaactcataaatatgcaattccctgtcctcctaggcacatgaaggaaaatttatgagcttcaggtttctatgcagctattaaagcatatttaatctgctttgagctcaagctcactctcgttggctctcttcgtttcttcctcttacatgagcaaactgcctttctttttgtttaaaaatagtaagtaggtttgttttcctccaggtgtcatgaatgcaaacattgtaatttctcatctgttcagcctttttgcacaacaaaatggcagcacccaggaggttgaaagggttaaattgttccttctctgagtagtaccataagttgttagtctgctactctttctcccagttggcacatgaccctaacatccaatcgctagtggtgtggccattttttggtcttattttggcctttcctcagccaccactcatcagttctcatgcgtatttgtcagatcctgctccccaactccacagttcttagttcatcttaagcatatggctgtctgtcttttctctaaagatcctcaagggaaaaaaaaaaaagcatctccagggggaatttactgcctcatagccctgacagagatttctgaccaaaccctaacgaaaaaatttcttccctccatttgtcttttattgtttttacaggggagatatgtaacataataacaattatattgcacataataattacttctacaaataataatctgttgtcaaaaatatacacagctttggatttccttattatggcccttcattaagttgtggtttaagaatagctatgattattacttttgtgataattataatccataatatggaaacttataaaattacctttaaagtgttactattattctggccacaggatggaaagttgttcgctagttactcatttataacctgaatgtactttttactgaatctaaaggtatcatctttgcttggcaattcccatgacttgtctttctgactcttcagatctcagcttaaaagctctcccttcaaagaagccttccctgaccactctggttttttcttctttttttacctctactccttttcccattacttgctgtcatagcattctgtttgtttcctttgaagtgcctattccaatttgtcattatgaatgagtttttttgttctgttgcttattatccattttccccactagattgtcaactctgtgagggcagagaccatgatactctgttcactcctatatacattcccagcactatcagactttttggcacatagaagatactcagtaaatatttgttgaatgaataagtcataaagaagagtttatattttaactcttagttgaataatctaagccaagaattatcaacctgggttggacgtgagaatcattaatgaatctttaaaacaatgacaaggcaatctatttattaattatctccaggtctaaactttagcacgtatatacattttaaaagcccataagtgattcttacgtatagccagtgctatctgtctcttctcctgtcctttcccctcctctccttactcctctctcatagttttaggattagcatggccccacaacaaatctttaattcacatggcaatttctaggatttatcatggaaaatgagccaaattgccttcaagaagtttttacgtacctcttatatagaatgtgatgttttatatgtacctcttatagaatgtgagcttttaagaggcatatcttattgcaagaaatttcaatgttgaaaaaaatattgaatatttataaagtcaaaaatgcaaacttttatatgattttcaaacctatgaagttatatcatgttcaggccttctttccagcatgtggctctcagccctggtactgtccttaaccataaacctcatctttgccctctatagggagaggtttatggttataattactcattttaaatagtgtatattagtaatgtacactatttgtatatttgttgactgcctcctatatgccaaccactatgctagaaattttgtaatattcttcacgatattcaagatattaacatatccgcattttataaatgaggaaactgctctcaaagaggttagtttacacagccagtaagccgctaagcctagattggatggaaggtatgtgagaaaaaagcagcatccataaggttttcattctcctaccctgtacgacagaggtaatagaaattattagttaaagaaataatagaattttacaagactctaggaagggagaatgtgaaggatacagttctcagttactggaatgagtgccagagtaccagtacatggcttgccttggggtttggactacctatcttaactcctttgctcctcccaatcttgatctcatttgtttgaaagatcatctgcccaacataaaaatgcatttctaattctgtaatttaagtcagtggcaagatcagattcagttaaagtttactttcctgacagctttttagtatcatatctattttgcaaaactctagtgataaatgtatgcacatttacacatacagcatctcttctgattctgactaagatattactgggttgtgtagaagtgatgggctctttagaagaaaggtttgatatactactaatctaaggactgaattttctcatctttgtctttgccccttttgactgatgaccagagcaggagcacataacattcttttgtgctaacagtatctctgcatcacattgatcaggagaattggcatctccagagccctgggatggtaacttctctgttgattttcaggaaagattaggtgatattttctccatgggaagaggatgtttgatgtgtgttggctttagcaaaaggaagcttgtggagtcaactgtaagtagacagaattgcctttgacttaatctgtttcagtcgttgttcatactcaggtcctccagaggacctttaagcatttttattgactttgtggtctattacacgaaactaaagatactgattctcagtcatgagtctgctccaaaattgcctagggaatcaaaaataattgtaccagttcctattcctggacattatgattcatttggtctggtatgaaggccaggaatctgtatttttaaaattcactcaagcaattttcatatatagctataattgaaaatctgtggctgaacttctccactcccgtatccatcgcaatacttccccaaggtggcatttaagatgggcctagagggttatataagatttcaatattaaaacatggattaaaagtgaagacttttcacatggagataatttggaagaaaaacttgcaaaaatgtgagagcattgagaacttttctttcccaaggaaagaagtggcagcttcatttttggtcattgcaaacagcagtgccatacatgaaaggaaagtggtggtgctcatcaactttgaataactttgtacagaacccttgagactcctctctgcttataaagaaaaagtgtcaactgtaaagttgatttatttatgaaccataggctactatgaaatctctgttcccagctagaggcctgggagagtaagataactacttgtttattccacggagccacttattagctttttctatagcacatacctcaaatgaagcatttcaataaaagaaccacattctattcacatgcttcattttattctgatttatgtaaaaattcccaaactcctcaagcagtgtttctttgtaaggcaataatcttcagttctgttgcaaaggtcaggagtgatagaatgaaaatggtactagatacaacagctctttggtatttgcatggccattacattgccatggggctgcaagacttgtgagtgcttgatattttgcttgttgatgaatgagtctgtgtttgtgctaatggagtgatttgagaggtagttctccactgtcagtcaagaggttggttttgaaagctgattgccaatggtcattctgctaaccactctggttctcctttagatagagacttattcagattcaagtcttcatgtactttgtggcataaacattgtacacaccagatgtattcaacaaccataaaaaaaaacaattaggactcaagtagtatgtcagagtgtagtcactgatgatatataattctccactaccaagaagatggaagcacactgttgagtagctacatcctacatatgttggccagaatttaggaatacacatgtgatctatacattttgaggtattgtctgacccctagaaaatcctggtgaagtttttctggtgtcagtttggtcttaatgtttaggaaatgcccacagactactcctgctttctgcttattcacatagtaaacgcaaagcacaggactagtttgtcatctggatcaaggagaaatgagttagcagatataaaataaatcagaaaggaggtagttctcaaatatttactccatgaatagttgctggatgttcattaactctatagcatttgttactacttattggggatcctggaaagaaaatatattgtctatatccactgttcactgaggccctctccctacccagaaactccctgtctccatcactcactctccacattcattgacccaggggaacagttcatggatgagtgaacttgagctctatcttaaaggatggagttcgatttcaaggcaagaggtataagagaaagttcagagacaacactggctatggtctttgtgaagaaaagtgaattgaataggctcctgtggagatcttaagtaagtacttctggagataaggttgaggaaaagtaggtttgaatcttcatccagaggtagcccctaaatgtgttgagtttattgaaagagtacttgacttggattcagacagatctgcatttgactcctgttttgccatttataagaatttgagtaattattgtttctaaataagagtttattgagccaagcactcagtaaatgtttgaatgggaaaattaactgccctgtttttctattgtcagatggtcctcttcgttggataacttggtaactgttgataaccttttctcaggaatcagaaggtagaaaggttgggaaaatataagaaacaaaaaggcatattcctatttttattttcatattgtcttccaactctcccaggcttctttgtttgcaaggctgacttttataatactttttgggtagagcaggtccttctttggtttggggttaaaccgtgagtaaccttattttctaggtctcagccaactttgaagggcatgaactcacagtagcctcactaggatcacttcagcagtgagaatttatctttcttgtataaaagtgtaagagttgatggcggccaggcgcagtggctcacgactgtaatcccagcactttaggaggttgagatgggtggatcacctgaggtcaggagttcaagaccagcctgaccaacatggtgaaaccccatgtctactaaaaatacaaaaattagttgggtgtggtggcacatgcctgtaatcccagctactcaggaggctgagacagaagaattgcttgaacctggaaagcagaggttggagattgcagtgagccgagattgcaccactgcactccagcctgggtgacagagtgagactgtcaaaaaaaaaaaaaaaaaagagttgatagcaaaataactatctgtagcataaacctcagtattctttatcattcagtatcaacattattactgaaaacaataagcaatatggactgagtttctgtggggtggaaatgtgaagtggatcatagcatgatataacttgtcatttggcttcctttataaacattatcaactacctcagctctatcaatcacttggcagtccgtagtgaacattataactcaaatgactagtcaggtctgttcattgcccatgtaaaggcatatacctgaagtgagaagtctgaggtaacttagcaataagcttgcagtacagtgtttagtgaagccgaggaattcaaggatttgagtcatgccagattgctccataaccatagcctatctttgtcacaagtaagaaggtttaaaaatcaccataccattattggtcacaacgtttggagatagggaagagtttgtggatggatcatggcagtgcatggacagtgattagcccataacacaaccagtgaacactgttgtacccaaagcacataaatcaccacatatactattaatatatttatggatgacaacagacactataattttatgtcagtgctttctgctgtgaaaaacaaagaaagttaagggtaccttttttatatttgcatcatatctccagaccttttcctttatctccttcttgcaagttcttctttctttcagctgactatctgctgttcctgctatggctcccagtggcttttcaagagggtacttgttttttaagagaagacccttgaaggacagagagagcctgaatcattcaaaataatgaattactcaggatgaaatttcaataatttgcaagtgtgtggagatagatattttgaggaagcataattttctatgtacccctcaaatcgtggctggagatgacagcctcttccacctccatataagaccatttcatttccttctacttttttctccctccttcccccaaacacacaaacatacacatatcctgtgcttcagtcacacagaacttcttactatttcatttcaattctctatggctttgcatgttctgctccttctgcctagaatgctcctttccttttttcacctggaaacatcccaattcaaatgtcacctcccttatttataccaactttgtctgtaactcctttatcacacttcttcctgtgattagtcaattcacttgtctgctgttacacctctatgagagatgaaaattccttctccatctctggaactcatgcccttcgcatatagtaggcaatctgtaaatgtttgaaggttgagtgaattaatgaatgaccttcaacctttcaggcttccaattttctctctgaaaaggacagccaaatgaaaactcataattttagaagatgaggttagacggttggtaggtgcatgcagagaccagttattatttaggtattatggaagtttatagttcttgtatgttgagttcagtgtaagagtggccccaaacatagttaatgaccactccagacccagttgttatagagttggccccagctgtattgcttctatttaagactaggataagaaatgacactttcctactttttaccttattgaaagggtagaggctcactgttatcaatctcagttcacttgttgattgcactggcttgccaagtgagaatattagcacctctgcacatttctatagctctgccacttatgagatctttccttcccattgtcatatttaataatcaggatagccctataaaatatgcattctcatttcccagatgaggatactaaggctcaagtaggagaacttacttgtttagtaagatcatacagctaggaagtgggagaggcaagagttgaacccagatcttcctagctcctagtccattgttctgtctactgggtcacactggaccagccaggaggcaggaaaatcagctggggaatgtggtgccaacgtgtgatgtttgcctaaatgtgtgcatccttgctggaagccagccatgattcatgctgcataagtattcattaatgttcatttcatttatttggctatccatatgctttccagggcgaaggcaagctaggacaagggcagacaagcagccttaaagtttgggtgctttccttcgaagttgagctgcctgtttgaaaatcacactttttggtgatagaagatggttccagtacagattttatttattactgcatctacatggatagacattttccaaagcatagctgaaaatatgtgtaagtcccagaatattttctgatttagacacagactttgagcatgataaccacatttagcatgttaggaaattctgtcagaatgcttctggaaaggctacctttccagaatgaaatgaaaaaagaaaaggatggactttgaaactggctagatttgggttatacttactcatagtgtgaccctggcaaatgatttaacttctccgaatttcacttttcttattctttgaagtgaaattttaaaatgccatcttgcctgatttttgtgagaatgaaaatgagatcccacaccaggaatttagaagctactcagtaaatattgcttctctcctttccccttccccagtcctgtcccccgagacattcagtagttattcacaggcatgcattctgaagtctgcctactgctccatgttgaaatgcactgctcttgcaaggactgattatctatttttctgtcttccaaggccccctgtgttccactccaccctcccaattctgggggcttccaaagtgggcaggtacagaatgttctgtggagcatcggaggctgttactcaatatcttggccagcactctcaactgctctttgcacacactccatatgaaggcaaactccagatcttggagcccatgtgtgtgtcatgcattgtactgcttcttgtacccaaatccatctcaagggtgagtagaccaggctcagacttgtcctgggagcagatttctcaagctgcccatgtccccacactgtttgattaaaaggaggtgcttcaaactctttggctttatatagactagaatcagaatgattggtggtgcctctgttctcaaggtatcccaaagcactttgtaaggaaatatgacaagcgctgaggccatgcaggccagtacaacagccgccacccagcacttcacaattagtcatgcccagcctgggatcatcaagcctgtttttattggaagagcaagagagagagggaatgctagctggcaatttccccaggtaccctttatgaaagtgcccttggctcttccaatttcatctgaataaccagctcaggcaaattttcctctatcaaaaagcagaatgtgatagtgacaagctgatgcccggctgatgccccaggacattgactaaatagacttggcctcacaattggtttttattctctatctcctttcttcccttttgttctttttctgtgtttctttccccattgccatctgcagagtgttctcagtcagaagtcagctgtggggtggacagtttgtcattttaagatcatccctattctgtctacctttcttatccctcatatcattgcttttagagcaaggacaattctggaagtgaaactacaataacactctgggctcctttccctctagtagtactcaacacacttgtaattacatgttcaaatttgtctttcttatttctacttaggttcatgaaggcaagggacatgcctgtgttgcttactttctcttggcaggcacatacagcaagtcttcaaaaaatgcttgttaactacaaattaagtgtttaagaagtccactgttaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaagaagtccactgttagtatcttttcccctgcctagtttgtaagcaactggcctcttctatttgtaagttacctgttttcatttccatatgccccaaagcaaactttagctcacggccttacagagtgtgtatgttagtatgttaaaatgaaatcaactttcctctcccaggccttctaattgacatgaatttgggagtagacttgcattggcctttgtcctgacagccaacagagtcctcttctgttgtattcactgttgccttccatgaggatcccatggagaaagtttgtcattgatatacattttgagggcagactcaacttgagtaaacctgattgagctttccccatctgcctcccagagatcactgcctgtgctttgttaaaaagagaattataggagtcctctcaaggcagagaggcctaaaattagacatggcagccatgcctttggtgtgcatggaggttggatacaggcagccagtttcccctctgttttctcccttgcttacacagccaaggagtggagccaagcctcaaggggaggagctgtatactcgagcatgccctgtggttcctggccctgactgagggactattttatatatcccaatagagaagcgtggaagacatctaggttgccactgtcatttgaaattggaatttttaaaagagaaacctgaagacttgaagaaagctttcttttgcctccccttacagttgatttttgagcttcttaaagctacctagtccaaagtacccacactcttattcttttgtctttcctactggttttatttttttttcatcttcccaggtgtttgatgatcactaagagcttcaacattgctcaccctgaccaggtatgaagccaagagtttggtttagggcataaaagaatgtcggaactcaaggactaggttgaggtggggaagggggatgaaggcttctttttttcttgggttaagcagaaataacttagatctcagagtgaaagccttgaattatcacatatatcactggaaaagactagttctttgctatgataacaattgttcatcatctctcccctgaggatttggggtcaaggcctggctacaccttttaatgatttcagtcatgtgacttaacctctttaaacttggattttcttcatctttacaatggaaatgatgacaataatcactacctcacagatattgataataatgatatctcactaggaagagaattaagtaatatgagggataaaaaggcatttgtaaatggtaaaatgagattatgattttgaaagctattattattttcctttcactgtctattatctcaactcttctattttcttgccttttgtacagcatggataatttagatgtgactctggacagagggatggatcagatgacttcttaagttatcttccagtttaggagttcgtaaactatactttctcctttccagactatcctagtaagaaaattctcttttaagacagagtagaactctggaattcatcagttttgatgtttcttaaagtgtaatctaagatagtgctcctgtattaagttctgatgtctgaccattgttcaaataaagagtaaaatgcaaatgacaggaaattggctgcgttctgaatcctatttttatttgggataacaataagcctgtatggtcactgtgacctttgatttgctgtttctgcaacctcacacttgtctcaggattcttcttccacttctgcactttatattgggtttcttccaggcatcatattaaactttaagccaggtatgtgtatatgcatgggctgtgggcctgaaaaaaattagcccgagagagaaaaaaatttaagtagtgggctagaagtaagcatgctactagaaacagaatttgggaacacagctctgggcctagaaaagcgacctgtcaacttgttacagttaacatcaataactataggatgggtttggtggaaaattatgctgaccaacagggtgggagagaatagggtcagaatatatatcgctgtaaggttgagaaaaaaagaagtgaaaaaaaaagaaatgcatagagagaaaaaggagtttagaggtaacatgttaaagtgtgagaaataaactggagagcttgacttctcttgaatatatttttaaataaagtactcctttcaactccaaatgcagcaggcttggttcccttctcctacctccattgcggatgaaagcttaatctttaagatgggcttgggtgggtagagtacgccccttggtgagcactgtgctctctgcaaccccaataaggcccaacagggctctccaaggaggcaaaattctgatgatacatttctgtttagtggaaaatgggtagggaaaattatgtcttagaatcaattaaccaaacataaaatcctccaaggggcttggtaggatgcctagggaagagccacgagataaaaactccaggctggaagggcattgttgcagcactgtcattctccagtttctcttggagttgtcaccaccctctcctttgttctcactgctgacatcatttgtaaaataatttcttcccttaaataaacaagacatacaatcctctaaatgactaaagaacagttacctagaagaaaccttagtggaaagtattttcttcatctaacggatgattgtctttacagaggtggagtaaaggatgtgcgagggagcataatcaagctaagagatgcatgctgacttaaaaggcatgatatatgtgaaactaagataatgtgttcaagagtgatgctttgttgatgcagaaccactgaattccttactattatgtttgcctgactatcggcctcttaataaagaacttgtggtttgagtgttcattgaaattagccatattaggtttatgtggggatgtgaggatctatgtctaccaattgcagcctctgctgcaaattggaggcagaaatctgggctgaacaataggtaagagtgtcaactctacagatctctcacatgctaagcaagcacaatatagggcaatccaggtttacacaaaggattaatttgggaacaattatcctcattttcacttcctaaaaagattttgaataagatgtcttttaagtaagaagctccctgaatgcatttaaaatatgatttgattatgtacatttcagatttttctacctttctaggagtatctctgttgtataaaaacacaaaattctggaacttttgaaaggaagatgtgcctctcttcatacatttgtcattcttgaacgattgtaaaatgaagtgactgcatatcacgtcatgtgccctattgatttcttttcttgttttaggaatattcccagaaaaaaaaaaaacttttttttttttaaaatctactaagcatgctaggtaagactgaagatgaatctatttaagttatgtcaatatctatttataaagatttttgtgatattcttttcactgtagaacttcaagcatatcctaaaaggaacggttagatacctctacaaactgtggcaatgacttactgagtaattgctggcaactgatttttggtgcttcttgttttgatagtatagcagtgcgagtaggtttcagaagagcaaaactaagacaatccagggaaatgccatttgagaatttctaactttaaaaaaacaagtaaaatagtgccaagaatattatctaactaaccccaaagtctacaatgtaactcttttattttgataatgctgttctaaccctatctacttcagtcctttcccacccagctggtttaggaatcaaattcccaatgtttcatcactgttaacattactgttttactcttcactttagttcttaaatggcatagtgtcttaaattccctcagcctctttcacatttgatttctttggaaactttttaccttttcattgaagcccatatgatcttttccgaaacagacccttatctttacctccttctttggagtctttctcctacttgaatttctgaacttcttaaaatggccgctttgggttggtgtcagtaattcagtaataagttttcttttctttttttttttttctttttttttgagacagagtcttgctctgtcaccaggctgcaggctgtagtgcagtggagtgatcttggctcactgcaacctccacctcccgggttcaagcgattcccttgcctcagactcccaagtagcaagtagcagcaccatgcccagctaatgtttgtatttttagtagagtcggggtttcgccatgttggccaggatggtctcgatctcttgacctcatgatctgcccgccttgccctcccaaagtgctgggattacaggcgtgtgccagtatgcccagccagtaataagttttcttaagtgctttcttaatattctgatatttttaaaaaagatctggactattttgtcatacaggcaacagaatgttaaaccatttcataaaacaatgacaaatatacatgaatttttcatcagttataaatgcatttcctttataacattgaacatgtttttgcaactgaaataagtacggttttcatttttagaaggcacatgataaagttaaggcagtggttaattaattttttcagattaatttttcagaaaagtgactgtttctgtctattgtcttaaccccaggcatcaaaggattttaatcagaaagaaccgaggaataatttggttattttagtgcctttttttgagacaaagtcttattctgtctcccaggctggagtacagtagtgcgctcatggcttactacagcctcgatctcctggttcaagtgatcctccaacttcactttcccagctaactgggaccacaagtgggcaccacactctctgcaatttattttaatttttcatagaaatggggtctcactatgttgccctggctggtctcagaatcctaggttcaagcaatccttccacctcagcctcctaaagtgctgtgatttcaggcataagccactacactcaccctattttagagctttgtcaagctttggaaagaaaaccatttataatataatagataaattatggatatttgaggcagtttttatcatagtatacatggtaaaccacagcccccctttataatatttgtatttaataaaaatgaaaatattacttttatcttaaacatgttttaacaaagcaagcatatgtagattagcactaattaaaacaaaaacctttgtaatgatagctgttttttatatgattacaaaaaatttactatacaaatttttatcctaatcagtgtgaaaaactgcaaatattagcttatagggctagtcttcagagtcctcttcctacctactactgctaataagccaatgaaaaactctctgatgtgtgtggtggctcaggcctgtaatcccagcactttgggaggccaaggtgggtggatcacttgcactcaggagtttaagaccagcctgggcaacatggtgaaaccctgtctctactaaaaatacaaaaaattagctaggcgttgtggtacgcacctgtagtcccagctactcaggaggctgaggtgggaggatcacttgagcccaggaggttgaggttgcagtgagccaagatcacaggactgcactccagcctgagctacaaagtgaaaccttgtcaaaaagaaagaaagaagagagagagagagagacaggctcctccgctttttcagttcctaaataattttccaatctagaatgcaaaagattctgaaggaagacagttaccatttcagatcggcagaagttgtggctttaatctagactcgaatatgttttacatcaaagggttgcctcaacagtgctcaaacctgcctctctgaaaacatgctgagcacgaaggttacttgaagtcttagcttgagtacttaagagagtgctatggagggattgttgatgagagctgtgtcacagctaatttttctttagtaattaaaggtttataaaaatcttacactgtatattgacaaatttagcaacaaaatgagcttgagaaaaaaatcaaggcctgccatggcatctttgcttttttttcttaaaaaaaaaactttttagaaagattatgcgactgtattatctgtaactactgcaatggtgtaaatcctgatggtataatttgctttttaaagctatctttacttcagtataacttagattaaatttattttaaatttaaatgatatttttctctttgtttattattttataatgtttcccatagaattcacaaaattcattagaaagatttttttttacttccttaggtcattaagattctgatttgtcaatggatttcacataaaccctgtctttccaaaaatatacaaaaaaaaaaaaaatagccaggcgtgatggtgcgtgcctatagtcccagctactcagaaggccgagttgggaggattgcttgaacccaggaagttatggctgcagtgagctatggtcacaccactgcactccagcctgggcaacaaagtgagaccccatctccaataaataaataaacaaataagtaaataattttcaccttgaaaagcttataaatgtatgaaatcacaatgagggtcgctgatatagtttggatgtgtgtccctgcccaaatttggttttgaattgtaatccccagtgttggagatggggcctggagggaggtgattggatcatgagggcagttttttcatgaatggctcagcaccatccccttggtgctgttgtggtgatagtaagttctcatgagatctggttgtatagcacctccccccttgctctcttgttcctgctttcaccatgtgacatgcctgctcccccttcaccttctgccataattttaagttgcctgaggcctcaccagaagccgaacagatgccggcaccatgctttctgcacagcttgcaaagccatgagccaattaaacctcttttttttttttttataaattacccagtctcaagtattctttatagcaaggcaagaatggacttacacagtctcttttgtatcagggagagggtcttcttggtgactccacttcttttctttgtttatgtatccttccagatgatgtatttatttcctttgtttttcaattgatatttactcttaaattaaactaattatttaaaaaagcattttaaagtctcattttagattattttgactatctgatttttaaaatggtttaaaaaatctatcttggcctccatatgcaatcaaataagaaacacattttaagcatattatttaccttgtggattctgccttcctcagtgtgttcagtctgtgtatattcatttctcccacactgtaagaagctagtcagatgtataattggattatcatgctacataatcttagcacactcattttaagcatacatagactagtgagcaccactcattacatgtcatttctctagagaaactagttgggccatggctgcaggactctcacttgaaaagacatgtgtggtgatgttttctcaggcagttaagcaataaagtgtaccctgatttgcactgaaaataaagattcctttaaagggagcagttctagttatctctctctttaggtaccatatgctgaacgtttttctatgcactaaaacagcaactaggttttatactctgccttacagcctacttcacacccatttcacagggagaggaacagagaggtaagtgatttgccccaaattacataactaggaagttatttgctcagtgtggaaacttgttcagaaggtcatttcattgaaatgtaggaagagtttctggcacttctcttgagcaggagtcaaaaacctttttttgcactagcccagatagtaaacattttaggctttgtgggccatatgatctctgtcaaaactcctctacttcgttgttgtagtgcaaaagcagctatacacaatcctgaaatgaatgggtgtggccgtgttccagtacaaccttacagaaaaggcaataggctggatttggctctgagactgtagtttgctgacctcagctcttgaactgagctctttaactgacctcagctcttgaactatggtacaagatcccatggtcctgtttggtacctccatttgccctccttttcactctctgggagcatagctaagttcaaaattgaattaggtacttgtagtaagagcatacttataatcctgggatcttcatgttgccagatattaacctcttgaagtttttcaccacaacctgggcacttttctgatttgctcacttctagccccacctttgggccccttcataagcaaacatgcaggttttccagagagctgtatgctactgaatgcagaaaatttggctcatactggcctatggactatctgctcactgccctgataactattttccaagggagtgggtgccctacctttcctacatgaagttttttgctagtcttgccctaaaaattctaggtatcccttgcttttaggataaatatgtttcactgggaccagctggaaaacgaaaaatagaattatccaactaccactttaaaattggacaaagacttttgttgttgttgttggagggggtggtaaacatcattttagcagaccaaatatacttttggtgaaaggcagcctgttgcaaagacacaacacttggacaagattttgaagccctggttgcctttactactgacttaactacagtatttgcggacttgagcaagttgcttcccttctgtgagcctcaggttattcatctttgaaatgagtataatacctgtgattataattacttatctggattctgcagagaattgaaggagataatgggtgtaaaagtactttagcgcccagcactgctccttatgaaaatgaggaaataattgagatgagtgagccattgaggcaacagtacaaaaagtgctgaaaactcactgcttaaataagcacctcttactgcttttgtggcactttgtagcaatgtttttttttttttttttgagacggagtcttgctgtcttgcccaggctggagttcagtggcacgatctcggctcactgcaacctccgcctcacaggttcaagcattctctgacttcagcctcctgaatagctggattagaggtgcgtgccaccacgcccagctaatttttgtatttttagtagagacggggtttcaccatgttgatcaggttggtctcgaactcctgacctcatgatctgcccgccttggcctcccaaaatgctaggattacagatgtgagccaccgcaccccacctcagcaatgtgtttttattctgactagaaaagtaatgtttggttttgtttggctctttgcttaatatacccataataagggtacctatttgcctttggaccattagttcaaatattattttattaatatggaattactgggctccagaagccatagtcttcttagctgctccctatccccactctcacctcaatttttttttttcacttttgtttttcttctcagggaaaggtttgaggcaaagaatgtcttcttatgatccaaaaccaagcatggtggtgatttattcaccaagagattcctaagtacctgtgtgatggacatggtagaatctttgtcctgagggagctatctagatccattccttctgatatgcagccagtagccacttgtggtaatggagcaatagaaacaacactagttcaagtggaaacgtgagatgagaagtaggaggtggagagaactaaccagaagagggtacccaaataaaccagaaatatgtatgtgttagagaaggggcctattgagcgggtggcagtggcatgtgtggcattacttgctcctgtattctctgctttttacttagttgtggctttggtggtatagtctcaaatctaagttacgtaggtaatattgttatgtatcatgttttggcaatgtagactaaatacttgctcataagagtacaggacaatgaggatagtttggttttgtttactgcatggaaaatgcaggatgtttagtaaatagattcatggcgtagtgagttcactactaaaatcagactctgagaatgggtttgatttaaatggctagtttagaagactgaatttaggccacttgattgagaaaggccattttgggtaattataaaccaccaacattgtgttttgaatgttaaagcttatatttgtcttccagttaccagaatgtaagcttcttgaggagggagagaggagttttcttaatctctgaacctgcacctttcttctgtgcctagcccagtgcctggcaccaaacaggtgctcaatcaatgttgattctatgctaccaacaaaaatgagtccatgatgtttactattcaacaaatgaatacaattttagagtaaatttttactgcttacactacatgtagattttctttttagagatttcgcaatgctgatttatttcaaaataagcttgaagctaagcgacaaagctgaatgatgatttgttttttatttatttttaaatccaaacttacaattttacatgtcattgccagaaaaatcattaaataaattatgatatgcgcatatggaatactttgcaaccattaaatcaaccattaaatactatgcaaccattaaatcaaccattaaatatgttggtatatgcaaatgtgcatataccaacatattatatagttgagtaagaaaagctagtttcaaatgagtatgttaatatcatctgactcttgcaaaaggaaaaccatacatttgaatgtacatatatgcatatgtttatatgtgcatagaaaaagctatgaggggatatacctcaagttgctaaaagtggctccacctggagagggacatggaaaggagttggctaaaaactgaggtttgttatggtatacacccctgcacagtttgattttttaaaaacaatgattataaattacttttattatttataaaaatattatttaaaattttggtactaaaaacagagctccatcaacaggtcaatggataaagaaaatgtggtacatatatacaaccgagtactattcgtcataaaaaaatgagaccctgtcatttttgcaacaaaatggatggaactggaaattattatattaagtgaaataaggcaggcacagaaaggcaaacattgcatgttctcatttaatctgtggaatctaaaaatcaaaacaattgaactaatggatatagaaagtagaaggatggtaaccaaaggctagaaaggatagttggtggggcaggggagggtgaggtgagcatgtttaatgggcacaaaaaaatagaaacaatgaataagacctattatgtgatagcacaataaggtgactatagttaataataatttaattgtacattttaaaataactaaagaggtataataggattgattgtaacacaaagaataaatgcttgagggatgtatacctcattctctataatgtgattagtacacattgcatgcttctatcaaaaattttcatataccccataaatatatacatccattgtgtactcacaaaattaaaaaaaactgtgcattaaagaaaaacaaaaataaaaaccatagttcaagttataaacaaaataaaggtaatttggaggaaaactgtcttcagttatattggatatttgggggacatttttgtatgttagttagcaaagatcacttgaaaaagaagattcttccttctatgattcaagggagcctagcaaaaaataaatgaaatgaaataaaataatacaaagagaaaagattattccataaattctgcttacttatttctggcaaacttgttgacagcacatgtgaccttttggtaaaaagacatttttatatttttagttaagtttcaaatataaattgtttgtgtttttaaaataaattaaatggatgatttcagccagatcattatgaaaacacatgagatattgggttatgcaatgactaacagtgtgtaccttttcttgatatttattcataaactggggaataaaagtacattttggcccatttactccttaaataattttatgtctcccaaggagagttgtaagttgcttgatagtaaatgctatgtattttgtaccttagtgtatatattatgggatttcagcgttagaagagctcttaaatgccgtgttcatagtccaacctgtcttctgatgcttgaaatccccttgcagtaggaaatgcaaagtagagagcagacactcaataatgtagttagtgaattatttagaaagaggcattttgagcccataatgtatgataggtacttctacatttattattttattctttgcagacctgcagaaaactgtaagaaaaaagtttatttcagattcatgtgtttatttgattaatctcttcataggtttcatttttcagctcctgtcagaaaatacagattcttataaggttcaccttttacccataagaataatagtataaaggggataatgtgaaatacaatcacttcacagactgtttcaattaaataagagctcgtagataattcagtccaccacaccccattttacagatgttgaaattgaagcccccaccaaaaggaaaagacttgttcaaagtcacacagcaagtcagtggtgaacctaattaggccccctgccttccattttagtgagattcctgtgctgatagtcatacccatatcaaatcctctttggcagttatagcttgcccacagtaatgtgtcctgaaaaatatgacaattaattaagttggagacagaaccataacctctttataaaaattttctggaaagtttacatgacagtaagtaatatataattagaaaggataattcttatttcatatttatctttttgtttcagaataataaactaagctatctctactcagtccattttaatacaaaaatatttttacccggactgagtttttatgctttttaggaactttgtatctgcctcacttagttaaaatcctagctgcactaatcacttactgtggtgggcagaattctagaatgaccctgaataccttgtccttgtatgattccttcctctttaagtaaggataaaaactgtgaatatgatatcactcccttgattaggctttgttatatggcacagttaactttaagaaaggaccaatcacacaagccatttgaaagcagagggtttgggtattttttaactggtggcagaaagccacgcagagatttgaacattgaggggaatttgaatttgatgtgccagtactaacttgaagatagaggaggctgcatggaaagtggcctttaggagtgatccctggctgacagccagtaagaaaatgagggcctcagacctacagccataaagaattctgtcagtgaacttgaacttggaagtggattcttcctctagaacttccatataagagtccagcctgattgacaccttgattttggacttgtgagaccctgagcagagaatccagttgacttctgacctaaaaaaaaagtcagataataaatgagtattgttttaaactgctaattttgtgataatttgttatgcagcaataaaaaactaatatatttaccatgcaaggcaaggcatttatcctctcatgattcagtttctttttacctgacataatggaattaatttatactgctgtgaagttgtagttgagaaacatgacttctaaagtaatagaggacatgtattattaattttagtagtattaatagtaatgatactgattctcccaggcctatacaaatcctttgatacacaaatgaatagtaaaggaacataaattgtctctaggtagactttcccacaatgcaattttaggatacagaggtcatatgcctgttattctactgtggcagagaaaatatggagcctggaaaactgttcatttgcatcacatacatcttgggagctcactctgaacctggtaccataataagctctgtagacagtataaagaggaaaggaatcagacatggtgtctgacctcaagtgtctcataacgtagtagaagaggtaaaatatgggtcacactaactctactgcaaagtaggaagtgcttgtcgccttgagattgacaaaatttggtaagagttcagaggagattgtctgtgaactgggccttgaagaatagttaggatttgaataggagaaggtgaagaaggaaggcattccagctagggagaagagcacaaacaaaagcatagataaccttgaacatcatcatatgggataattcaatagttcagtataatggaagtataagatgcataaaaataagtgtagtaggaaacaagtttaaaagtatagattggggttagtcatacaaggccttgaatttcaggctaaggagtttagacattaacatttgtttttgaacaaaggggtgaactgatcacatctgtgatttagaaagaaaattctagcaatagtgtagataagggttgatggtaaagtttggaaggtggtgaggcagaggctggagacagggagcacatttaggatagaaagatgataaagagatgatttagaagagttgttttggaaaaggagaagacagaaaatgttttagaggtgtcatagagataaaattggcatggcatggtgcaaggaggtaaagcccaatagctttgtaaggtgctgagatagattgaaatcacagagttaggaagttttagagtcaggattagtaccaagacagcttggctctagatctcatacttaacacttacagtataattctgagagggtgggtaacagcaatagtcagaggaaagaacccttttatacatgatggtacaggaacaacactggcttccaaccccacagctgctctttaacagaaggtcagaagctggggagaaatatgtgtgtgtgtgtgtgtgtgtgtgtgtgtgtgtgtgtgtgtgtgtgtatgtgccatttctgggactaaggatgggaagtagattagttgaggccactgcagtggggtctgcaagttgctagcactcacccgttccaagaggccttaaaggtgttgatctgttccctgggcatcaccacattccacaaattaatgttcctctgagagaatagggtgattcaatttcactgtgcccgaaggttacttttggggttcatgtttgttctaagtctatgctaatgatctgccaactgtctgtttgtcactttctctaacccttagcatgtataaactgatctgttgggaaatgtgtagcatttataggatggtaggatttgtaacatgcgatcacaggactgtttatatagagtccctgggaaggggagagaagagtatttctgttacaaatgtggattctttggcccctcctcaaacttactgaggttcaagaattgacatttataataagcacatatccattttcaataaacatgaaagtttcataccctcttttaatgtttgaaatcctcaaataaattagtcattggtgccagagtatcaaataattatggtacagaatgtatttctctgaatgacaccttctcccagagattctgatatatattcctctgcactcaccctgtttgataattaccagtatatggaccatttacctgaagaataagagtagggtttcctactgttgttgaaaatttgcttgactcttaacaacttgtgtgtgactgtaacaagatcacacagggtaaacaatattagcttattcaaccactggctgaagaaatttaggaaagtgaacacatttttctttacatttctctttgttctgtgagccttttatgctggaatagttttcactgcaggctgttattgtctgcctccagaggagggagttgacctagcagtggtaactggagagtgttttttgaaacctctttccaaggttagttgccaatggcatctttggaacagtgtccttcacttttgtccctcagggaccagtgtgagaatgggaactttatgatctggagctggttaagtgaagtccaaaaataattaagaaagtgtttccttccctgggaatgagttcagtaggaatctcaatgtattgtagagcactaaggactcagcctcaggcatttgcaaaggattcttccagttgcctgtgttacagaggacacagttggcatttccttttggtgttgaggggagatgtgtacatggttgtgagatgactcaccctttttgcttagatagttccactttcattgtggacagactctttggagggccagtttggcatgcacgtgtgtgttcattccatcctggagcattctttatgagaaagccatttgttgagtggtttgccattttgttttacagccactctgtgggctatgaaatggtcatccggccgctttatttgtccctaaaaaaagcagtttttccctttcttatcttcatggctgccaagcagcagaaagagtaactcagggaagccatgtgatagccttttatctgtctgttcagaaactgatgatgtattggatttgataattcatcaaatctgaggtttactggtttgtatttgcctcaaaatgggcatataatattttgtcaggtaacataatagacagatcattggcattgctttattgaagtgaattaattcaataagcctgtaagtgcctgacatgtgccaggcactgtgctaggcattctgttaacagatgagacaaatctctgtcttttaggtgttttcagtcgaacaggggagacaaatatatgagcaaattgctattttttttaaatttcatagtgtacatgagtataaggtgctgaatatgtgattgattctgagggaaaagagagataagggaaagttctcagagaaagtcaagctgagggaagaaaagcaccccagacagagggactagcatagagctatgctagtacattgagtttaagggaatggcacatacttcactgttgcttcagcagacagcaggcctgttaggttacaaagggccttggatgacatgctgaggggttttaaaattttatttaaattttaattgacaaaatataattgtatatttctgtgaggtacaatgtgacgttatgatatatgtatgcaatgtagaatgattaaatcaagctaatttgtatatctaccacctcacatacttattttttggttagaacatttaaaatttattctcttaacaactttgaaatagacaacacattattatcaactgtagtcaccatgttgtgcagatctcaaaaacttctaacaaaaactttttaccctttgaagatattgaactgttttatgaacacaatcttagaaggatttaaaaaataatttgctattcaccaagtacttcttacgtacactgtgcatgaaatgattattactttttctaatattagttttcttgattgaggcttggcaattattagtttgtatgcctttagaaggatcataagcagaggtttatcccagtaggatttgcattttagaatgatgactttgggagtaaaatacagagaagtgaaaccagagatagtgggatcattctggagtctgttgcctacactgaacagtagttgagcgaaaaaggatgggcagaatgtgttggttctgggtattgcaaattcatggcacttgagtgaaaaagtttaagccttctattggctctttgtgaatatcttcaacatgcatgactacaaatagaacacatggttttgttgttattgttgttgtgtttttgtttttttttttatttgagatggagttttgctcttcttgcccagactggagtgcaatggcacgaatttggctcaccacaacctccgcctcccaggttcaagcgattctcctgcctcagcctcctgagtagctgggattagaatcatgcgccaccacacccggctaattttgtatttttagtagaaacagggtttctccatgttggtcaggctgtcttgaactcccgacctcagatgatcctcccacctcggcctcccaaagtactgagattacgggcatgagccaccgcgcccggcccacacggtatttttgaaagaacagtgagcttggattagaacactagtgtccaggccctgctgctactacataagtaattatgaatccatagccatcttgttgctcttcttctctgagccttggtttctttagctataaaatgggaagttgaaactttctagctacttctttgagttatgagtaacaagttaggtaatacacttaaaagagaatgtgctatacaaatactggttcttaagacagctgttgttaatgtactgagtattatgcttacctcacagggttattgtgagcatcaaatgggataatggatttgtaagcattttgtttaaagtgtgattcaaatgttaagaattagtaaaaatagtaaaagaacaattcattctccatccagatgttctgtccccactgtgacttatgtgctcattcagagttgtacagaaaaacctccacttaattttcacaagctggagttccacatgtaacagaatcatatgggaccaaaaaattctctgtattggcttcttccctgccgtattttggctctgggaccaacaagacacccattttgcatgagctgcctgccaccaactttgcgctcacatctagttctgttgcccatgtgcaagctgaatttgggcccgggcccccagatctaacatgaaactcaagtttccttctgttcaaactgtccaggcataatagtcttaaagtccgatgcccagcagagccgtagatttttcactggccaaaaatcaacatgaaaccagatgtatctgtaaatctagtttcataacactttgtagtcaatggaaatacagtagcaggcagaccagaccagagtttactatttgcagtggaattaataaccacatggaaactttgcctttggtatctgcgagatggaagataaaggtgcgaattcaaagcagttcccaccttaccctctaaattccaacataaagaggccttgaatgtccttctatcttattgtatatttcattaacagaagtatgttcctagctacttagtcattctatctctattctcctttgttttaacttcagtggtgccagcttaagatgctctggctttcagctttcatggagcacgtcatgtttttaaacttatctttagggacagaaatgttaggaagatcctagttcctcatctctttgctcctgacaaggaaatttagaattgcctaaagaaaggatgtattggccaacctaataataaatcagtattagtgaatctaaagcatatttgaaaaatttgtaacatgagttgaaattcagacctgcaatgaagtgtttttaaaagatttaaaatcgaaataatataaaagaatgttaaaaacaagtaaaacatatcactagttaatcactctaccaaaattcatttttatgtttgcatatttaaccatttttattttctatatttgtccatgaacatgtgtttttatatattgtttatattaaacatggttttaatcatggcttatttcttttatgttttacttcttttcctttgacataaaatattgtattttttaaattttaattgcttcttggcatacccttccaatattggtggctatatagattgaagttaaaactaattacaatcagagaaaattaacaattcatcccttcaatctcattagtcacaagttaaatactcaatagccacatctatctagttgctactgttttgaatagtacagatataagacattttcatcaacacagaaaattcacttggaaagcattgccctggagtaaatgtgccagactgtactatatcatttttctcttgttggacatctaagttatttcttattttttaaatattttatataacttgacggtgaatatacctatgtacatagctatttgctttggctgaattatttcttagaatcaatttcaaaagtggagttattaggtcaaagagcatgagaagattttttggaacctgcagtgtattgccatagtcctctcaaaaaagtttatgtcaacttaaagtacttctagcagcatatgattgtactaatttcgctgcaatctcaacaacactggacattataagtttttattctaccctattttccattaaaagatagcttatgcttgattgactttgcattttattttattattaataatgatgtggtttccttttttctagattttatttttatttaaggcatcctttgattttaacctgattttttttctctaaaaattattctaagaaaagacaaaggtgatacgaaatatatcctgagtttttatttttttcttgcatgggatttgtatatttgcacctttgcccatttatactatgatttcttagtgtcttccctggcaattttaatgaagacttcatgtatatcaatttttccacaaatataatctttctaaaaatatgttttttccacaatataattcagacgtattctccgaaatgttggaaaaacttaagtaggcatcaaagcatttgaagatttgtttaaaggttgtttttataccagttttaaattgtaatttaagggtcataaaataggtgaaaattaaatcatttttcagtaagggggcaagaccacttaactcttggaaaatacaggaaacgtagatttctagaggccaagaaggaggtagggattattttgtaactgcccccaaccttctaacctgtaatgaaacaaacactgaaggcccttaaacatttttaggcttaattggctgtccttgtacttagggcacatctaaaaatcctgaggcaaccactcaagagaacatgcttttgttaattcaaagggagctgtcctacgagtgtccagaatcctctgtagtcttgggcctggtgcttgagagacccaaaggaaaggtcaatggaattacagcttagtgttagagctttcatgcatcacactaattaattaatgtcataaaggtctctctcctgttatgggaaaaagcagcaaataggaacttctggtagggtgcttaaagttggtttgatattttttattagcatttttaactaatacaagtaatacatgcttatggtagaatgataaaactgaaaaaaaaggtatgaaaatttagaagttctcctactcatgacctcaccccttctttcactcccagtttcactcctcagagggtaaccacagtgactagcttcttgtgtttggttcctgagattttctatgtatatatattgttagatatatgcatggtatgttttcaaaattcctgttacactataattactgttctacaacttaattttttcacttaattaatagaccttatatatgcttttccatatcggtatatatagatctatataagttttcttaaaggttgcacaactttcaattgtatggctgtcttgtaatttactttttgtttcccttactaatggatatttcatgtttccctaactcttttgatattaagagtagtgctgcaattaacatccttgagaggcagtatatatggtgtttaagatgaatggttctggagccagactactttggattgaatattggtgccaccaattccttgctgtatgaccttaggcaagttgcttaatttctttgcctcagtgtccttgtgtgaaaaaatggaggcaataatggtcactatccagtagggcttttatgaggatttagtaagttaataatgcactttaagaacttagttatttttagattaagtagtgaaggactatataattgttagtataattgtatacctttattatcatacttttgcatgtatagcaataagacaaattcttagatgtttaaccattggacataaggaatgtacgcattttaagtactggtagatattaccttttccctgccaaaaattgcaaatattggatattaactttttaaatcttagtaaatctgataagtataaataacagtttatcatcattttaagttgcctatcttaattttgtgtgaaaatgattatcttttcacatgtttttttggccatttatgtttctttccatgtgaactaactgttcctggccattgcctatttgttgttgctgttactatatggcttttcatctgtttcttattggtttatggagctctttgtatatacaggaatttagcctctatttatatgtgtgacaaatactttttccaatttatctttaaaatttgtttatgttttcctattcatcagtctaaaattatgtagttaaattcatcattgttttttcttatgactttagagtttggagatcatgcttcaaaggtctttctaggtggggatgatttaaatcatgtactggaagtatttttgccaaaaagactcacgaattatggatgttagagctaaaagggaccttagagatttcctagttcaaccaccttttcttcatacctttttaatttttctctgcagatgaaaagaagtttagtcctaaagaaagaaaagagtctaaaggttctccagtaagctaatggcaaaaatgtagactggaacttctagctcctgatgtgtatttcagtgatcattcaatttaaccagatggtttcacaaaaagagctttctactaaaaaataaaatacatacttaagcaactcagagaattttttttttatttttcagattaattttcacttagagattcatcagcatatgtactatacatgtacaaatcacctgtgtgttttggatatttagttaaacaaatgtgcaaatattttaaccaaaggagcatattcatttgtgttttattttcttaatggttttcgttatgaatgtgaaatgtgtatttaccttaacagaaattaagtatatttttggtctgacatatatgagaactgaaaagcattggcttggctgctaactgcattctcatctttctttctctgctttggcaaagtctgggattaaatctaataccttttaaactgtttgggacttcagccagagtgacctgtcttgaattcagaactgcgcagatcattccccattctaaggccctctcatgcctcctcattgcctgtaggatgagatccaagtaccttagcatagcttatgcactgtagtcacttgacctctagcacctatgcagtcttccagtcttatttacacattcctttgcacatgctgtttccccgtgtggggcaacttttttcttgcctgtctgcctgcctaagccaacttaaataaacatcatttctgtaacttctgtgaagccttttccaatctctccactccaagacgaaggtgtttctataggcatgacttctggaatggcagatcaaggatctggtggaccctctactcagtgaaacaaccgtttaactagtaaaaatgatcaatcaaccatttaaaatcttcagaaaatatcctaagggcacatagcaaaaagagaaacatttattcaagaaaagctattaagcctcagtaaaaacagcaagagtctatggcatttgagtcatgacctgttcctaatccttcccttatctccattcttcaggcaagtgcaaccaagaagatggaggcttcctctctctcaaaatcttactccatagttataatttcacccacaatggggcagaccacaagcatctcttttttttcccccagccctatattacagaatcactgttctaggaaggcatagcttagaggattggagattccttccacacccactttctacgtatgagggctttgccccagggatggtaagtcaagaatacagggatcctgcttgtgcctgcctcagctcatatataaggtaaagcttccacactaggaaaggcaaattaagaggactagggaatataccgttatccccagggtccacttgtagaacaggggtgtcattctgggagaagcaggtcactgccccacttgtggaacaggggagtcactcgtcactgtccctggttcaaattctattgcagtgacagaggttctgtcccagggaaaggcaggttgttaggatggagaactccacagttctccctgaggtgactgactttatttggaacagagcatgaagaagttcatgcctaagggcactgtcaaaaataatggagatcttggtggtgagcaattaagagtggattggtagctccatgatactagtaacaacaagcaaaacagcagaccagcatggaggataccagagaaccagacaaaggaatcactaagaagagcccttgtggaattgcactcactgctgggtgtgtggaaagttatgcatgtgtgctttactgtaccctctcaaaagcaacctaaacaggatgtggggtaggctctaaagcattcctcaagccacacatggatccatcagtaaaatgtggagggcttaaggataaaaaggcttaagtacaatctctggccctacattttctaaatgttatgccaccctgaccaaggggcaactcctacaaagccaggcaaaataataaaatcatatttgtctctagtggaatggataactatgcctaaaactgtgccctttgaaaagcaactagagagataatttctgaagtgtttgtccctacctgaatgtgtggcaaaattctaaactccctgaagtgtgaaagtggtttccaagccacatgcacatccagtagtggtaaagggtgaaaatctaactggctaagagggcttcatagcaacattaaccaaaaagtggtttatgtagtctttgcctgcttcataattccctaggcattctatgctattctgtactcagaaggcttaaagtcaggttagggaaaggaggcctatgaggttactgtgcagaggcagtgctgggaaataaatgaagttaaataaatttaggccatcgtggtttaaagaatggattgtggagataagaaggataaaggaaacccagagtcaagaaaaataaaacttttcattggtgccatgccaacccatatccgagcctgaggcaaaaggaaaaatgtgctccctgatatacacttatacaaaatatcaactaattttatttgttggactgaatagaaaaagtcaacaaaaattaaaaataaaaaaatcatgactatatttttaataagtggtttatgtaaacccagagttgaccaatgggatgccagtctcaaccataaaaacaaacaaaacattgtgagtaacaacaccagaagtctcaaagtgtcagggaaaccaatttcacagaagcagttcagccaagtcactaaacaaacaaacgactaagcaaaaaacaagaatgagtctcagaaagggtcaagtcagtatccagagttgttacaatatagtatctaaaatattgttttgaactaaaaattttgaggcatgcaaagaatgaggaaagtatgactcatacatggtattatatgaaaaaatcaacaaaaaactatccatgaggaaacaaagatgttgaaattcactagggaaagactttaaaaaccagctatttaaatatattcaaagaactgaaggaactatgtctaaaatactaaaataaagtataataacaatttcttgtcaagtagagaatgccaataaagagatagaagttataaaaaaagaaaaaaatggaaaatctggagttgaaaattataataactgaaatgaaaaattcactagaaaaggtcacaagaagatataacttggcagaagaaacaatcagcaaattagaacatagatcaatatagattattcattttgaagggtagaaagaaaaaaagaatgaagaaaactgaagattcccaaagaaatgtaggacatcttaaagacacatcattaggagaagaaaagaagggaaagaaaagagcagaaagaatattttttaaaaaatggataaaatcttccaaaatttaatgaaaaacatcaacctacacatcaaagaaaatttttttaaaacttcaagcaggaaaatgtaacgatattgatacttagatacatcatagtcaaaatattggagtcaaatataaagagaaaattttgaaattagcaagagaaaaatgaaatggaaccacaataagattaacagctgattctcatcagaaataacagagagcagaaggcagtgcaatcccatattctaaacgttgaaagaataaaaaaactgtcagtcaagaatcatatattcaacaaaactatctttaaaggtaaaaatgaaatgaagacattcctaggtaaacaaaggctgagagaatttttcattagctgacatgccttgcaagaaatactaaaagcttcctagacagtagctttaatctgcatgaaaaaaaattccaataaagggaaatttgtaaataataaaaatacatcattatatattcttttccacttaacttatttaaaatcaatttcttaaagcactatctgtaaaattgtattgttatttgacaataaaatgtaaaagaggggagtgggaattaagctaaattggagtaaggaaatggtatcacatggtaaattgaatttacagaaagaaatgaaaaaattaagtggcaaatatgaagagtaacattaaaaacttctataaattaattgtggcctcctttcttcccttagcttctgtaaaagacataagactattaaaaatgacaataattataaacacattgttttattagtaataaacatagacaaattatctacaacaattattattatacaaggagagggaatggagctgtagaggagtaaagtttttataacctactggaactaagtcagtataaatatgatgtcgattctgttaatttgagatatatgttagaagccccaaagtaatcactgagaaaatgatgcaaaaatacagttttaaaaagttaaaaacatagtttagcttatgtgtgcctagtactccattattatttttttattatattttaagttctggggtacatgtgcagaatgtgcaggtttgttacataggcatacatgtgccatggtggtttgctgcacccatcaatccgtcatatacattaggtatttctcctaatactatccctccccctgtcccctaaccccctcaacaggccctggtgtgtgatgttcccctccctgtgtccatgtgttctcattgttcaactcccacttatgagtgagaacatgcggtgtttcgttttctgttcttgtgttagtttgctgagaatgatggtttccagcttcatccatgtccttgcagaggacatgaactcatcctttttatggctgcatagtagtccatcgtgtatatgtgccacattttctttctgcttgttcccaggagaaagtggctgaagattccagagagaagctgaatgcagtttaattctttttgccataaacacgacaacccattttcctgcaagctgtgttagtttgctctcttcttggttcattcattcatttattcatagcttccataaatatttaacaaacactaattaggggccaagccatgtgctaggcacaggggataaaactgtgaacaaaacaagccccagctactcttaaggaactgatagacaaatggaccagcaaacacgctggtcctgttttgaaggcaaagcgcctggtgctcctgatctcatgagcacagagcatttagcctaagtctcatcctcctaaggcctcagaaataaggccttattttaataagtgcaagtcagtcatttgaagactaaatcatagaatcctagaaaactagtaccgggagcaaggcaaaagaatgggatgagcatgaaacatatattcagaagttgtggtgtgtaggtatataagccaagctcttttcttcacttgcttgctaagtcacttagcttttctgcctttttgtttgctctgtctggaaatggagttaatgaaatatatctacatgatagggatattgagacgattaaataagatgctgctgtcacccagtatgcccttaccctgctgtacttagaagtatatgaaattcattttctaaatttttgtatgagtgtttcatgcatgcccaccaccatggaagctaccttaagacagtgagggactttgtttaacttgtttgtactacatcctcagtctaatggtgtctggcttatggtaggcaccaaatataattttattgacagaaaggatgataatgaatgtgaaggcatttttaagtttatgaagtgttgtgcatattgttgttaattttaagctgttacgttaaagaacccctaatccaactctcttgagttttatagatatcatagaagatatatcttcccttgacatagaagcttcccttgaaggttcccttgactcatgtatttgcctcacagtgattgtgcagatcccacaagataaatttatgtgaatgtgctttatgtgcttgaagtgctccacaaatatgggttttataagatgagaaaatagagtcagggagaaaggtgactgatccaaggtcatgcaaagagttagtgtcagaatttataatggaatttcaggctcccaactcccactccagtatactaaggcagattccagagaagaaacagtggagagcaggcactgatgagggacaaagaaaagcaggctccgtctggctgcaacttgtctcttcatggcaaaaagaaactaggaaagtgctatgccagagacgacatgataactttgcagaatggaaagagcttgtttaccacattgaatactttatctgtgtttatctaacgacagttccaccagctctttaccacttgacttttgcctaattcaaaaatataccaactatgaaacattttccttctcagtttttattctagattacattttgttcaactttatcttaatgtgtagtgtagaaagagtaaggtaagagtatagcaagtggttattttccatttctactgaggacagagaaataatctaagggatttgtattagagatgaagaagtgcatggccaggacatgagagatactgtgatagaatggatattgtgaagtctttggtagtttttgaggggaaaaaagagaaggttttctttgtctgatatagtttagcaacgtcttaatttaggattcaaaagttgttcagggtccatcttggccttcaaattaagatgccctttgagagataacattgttgttttcaaactctgttctgtgacttaagaatgagaggagaaggaagaaaagaggagaaaatttgagggaaaagtgcccaagcagcgtcaaggctagacactggaaatttatcaatgaaagccacatggtggatgggaatcagatatgtgcatcaattatttgtgttccaatccatatagaagtaccgtataatgcaccaagctaataggtgctttgaaagaagaccatacaagtggagatgtgttcctattctatctagggatagagtcaggaagggcttcattgaataagtggtagcctcttgggctgagacctgagttatgagatgatgtggcaaaggagacagatggctgggggcaaggtggggtcattgaaattggaggcagtagcaatataagcaaagctacaggggcatgaaaaagcaaggttagattagtgaattgcaacagggtggtactgctggaaggtcacatggaaaagattgtgaaggtattgagataagaagctagaaataagctttgaatgccatcctagtactttgaatttgcatgctgtaagccaagtggttttcacttggtcatttaataaaattacagattctcaggtctcacctgtaacttcagattcagaagagtctgctaactgaaggtggaatcagtgttccatattgctaattagctcctcagaggattctaatatatcagtgagttatgaccactgctgtaagccataggtagttattgaaagctgctatggagaggagccacagaagcagatgttttagataggattcctctggggtcctgtgtaatttatggactggagaggatcagacaggaagcagaaagacttgaataagacagttgcagttattttggaggcaaagattctctctctctctctctgtgtgtgtgtgtgtgtgtgtaattgtaggaactatttaggcagtaaaattaacagatattagtcactgattgactgagtggatggcagtgataggtggggtgcgttgagggaagtgtattacattaagtccaggatgactcatggttttctaagttgagtcattggggattgccatccaatgtgagaaactatatagtcttatcatagttgatcttggaggtagacttgaattaaaatcttgaagccatcaattgctgtatgtgggtcttgggcagaacacttaaggtttctggacctcagttatttcttctgtaaaatgaggaaaataatgcatacctcatgcatttgttgtaaagactaaatgaggttaaagtatgtagagtgtagtttagtaactgggacgtatagtggtccagtaaacatcagctgttattattgtgctatatgttgtgatgtgtactggagtgagatggggtaggggattttttagtctctgccaatgactcctctccccatgatcaaaatcagaaaatcagtctcttatgtgttgaggagtgagacacttctcccaagtgtttaaggctaataccttgccttgttttgccttgggccagacctcactacacatctgtttaagagatcagggtaagctctgttcttggtgagtatctcaatggggctgtttttctagttcttgtagtttctttgggccaacatgaaatgtctaaccttggcttcttggttgtggattctcgtcaacatttcactgctacccaagttgtgtctgcttacatgatgctatcttccttcttttgggtttctgaagccctcagacacttggctgaacatttttcacatttcttaagctatatcatctgtgttttccctgccacagacaaagtcacaaaaggactttaagataggttttggttttttttttccccagggtttttatacattttgggtaagggcaagtggtaaatgctgcttttctgccttaaccagtagtgtctgacagaggaggtagcatgatgattgcagagctcactggactgaaagtcagatgctttacccgcctagactctagtaccaaggggaagatggagtgagatggggtaaatggggagaaattaccatttattttgagtgtgccaggccttttctcatgtattgtctaatgcatttgtcacaattctctttgggtttgaaatgtgattttcttcattttatagataaggaaacttatgggaagggaggttaggttcatcttgtgcccaactttacatggctagtgatcaataatagtgagattcaaactcagatttctctgccccaaagcctttgctttttcctcttttgacactgtaactaatgagaagatgtatttaactctgagtctcatttgcctcaactgtaaaatggagctctgtaactcttgctctgtatgacagtaaatctcctcagaccagacttatgataggggataaggatatttgtatctttgggcccctaatgtattgaaagtgcttctaagtgcctggcacatagaagggcactcaataaatatttaccacattttccagaaagagggtagctccataatgggtgagatacattttggtggctactgtagtgtttaatgcttttaccatctgttaaaatgattttggagtatagctagataactgatgatggttgttatatagattttttcataggttgcctgttccaaattctatgccgtggaagaagttaaatatccagaatttgacaggaaatattattctacaacagatccctggcgtaagaatgataacacctgtgttctagtctcagacttgcctctgaataactgtttctcctggtcaattctctgtctctatctaggcttgaaatttcccccaaatgatgaaggagttggactagtttagtggggttcagcctcgagtggccattaaaattatttggggatctttgaaaaaaattagatgcccagatttttgtcgttgttgttgttgtttttgtttgtttgttttttaattatactttaagttctgggatacatgtgcagaacatgcaggtttgttacataggtatacacgtgccatggtggtttgctgcacccatcaacccgtcatctacattaggtatttctcctaatgctatccctccctagtcccctaaccccagacaggccctggtgtgtgatgttcccctccctgtgtctatgtgctctcattgttcagctcccccttatgagtgagaacgtgcagtgtttggttttctgttcctgtgttagtttgctgagaatgatggtttccagtttcatccatgttctttcaaaggacatgaacccatccttttttatggtggcctgatattccatggtgtattgaactgctcactccagttcaattaaatcagaatacagaatgttgagaggagcatcagtattttaagaaggccccctagtgaagttcaatgtgcagccaagggtgagaaacactggactagatgattgataagggccatccaactttgatagtcaacaagagacaatgctatagagtatggtggacagagcatgggctttagagttagccaggtatgcattcagaccctggctctgttacttactagttgtgtgatcttgaagaaatcaaaatggagatacactatgtacctggcagtaatagttgtggggattaagcaccttcaccagagcttaggacataataagcccccagtaaatagcttctttaatatcagaagttcagatggaagatgtgagaaaaatattggttcagtaagatttaacaggtaaattaaaatcaagtatttgaaaacattttcctgtttctttagcaatggattccagaaacataatgtggaaatagctctcagtccttagatttgatgacattgcagaaagaaatctggctagtcgtcccatggctgattggctatgatggctagaaagccattggaaaaaaaaaattggctcacagaagacagcagatgtggcttgggaaatgcaaggacatgactgtaataaggatttgtctatccagccccatttatgagagtgattccaggagaaaaggacagatttgtattgtcagtgggatacgctgttaaaaaacacttttgctactaccactccagctgtcttggcatgtttgttggtgatgtaagctacagaaaatggaaatcaccaatagggctatagcaacctgatgcatagtgacaagtaattgttctattcatggttatgtgttgtacagagcacttgctgcatgtcaggtttgagacttgagtatgcattagggccatggacacccccatcttatctttaagtagatttcaaagtaaatatttgatgaatatgtaaaatatttagtttggtcagtcatagggctgagaacatggtggcagttacctcctagtatctgcaagcaaaaaaagttttttcttcctatagcaattgccatctcagccacttttgcagcatttctttttgctacactttgcattaaccatttgtgcacttgtcttagcctcaaacaggccatgaaagctccttgaggataggggctatgtctttttcatctttatatatgcatcatttagcagagctgtccctttataatgtactaattactgaatgaagggatgcatagatgaataaatgaatgaaaagtaggagtgacctgtcttctctctttcttcacgatggggactagtgtgtgtatataaggggataatttttgtgtcacataaaatataaccttacttagaaggcaagacttccagaatggtggaatgagaaccacccccccgcccccataaatccgccctttcatgaaagcagtgaaaacgctagcaaacgttgtgaaaattaacttttccagaactctggaaaggaaacagaggcttccaacaatctgagaagaatgtattcaagaaaaacttcggtaagctctctgatcacagtggaaataataaacaattagtaatagaaggatagttgggaaattcaccatttgtgggatataaacagtggatcaaagaagaaatcataagggaaatgagaaaatactttgagattaatgaaaatgaaaatacattgttccaaaacttacaggatacagccaagctaaagcagtacttaaagggaaatttgtaactgcgaaggcctatatcaacaaagacaaatgatctcaaatcaagaacctaaccttccaccttagactaggaaaggaacagcaaactacaaagaaagcaggaagaaagactaataaagactaaaagggaaataaatgaaataatagagtagaaaaacactagaatcaatgaaattaaacattgattctttgaagagatcaacaaaactgaaaaaaactttagtcagattgaataagaaaaaaagagagaaaattcaaattatcaaaatgagcaatgaaaatggggccatcactacctaccttaaaaagaattttcaaaggattaaaagaaaatgccattgcattagttcattctcacacaactataaaaaagctacctgagatggggtagtttatgaagaaaagcgctttaattgactcacagttccacagtctgtacagcaggcatggatcatgaggccttaggaaatttacatcaggtgaaaggctaaggggcatggaagacatgtcttcacacggcagcaggagagagagcaaagagggaagtgccacacacttttaaaccatcagctctcatgacaactcactcactatcatgagaacagcaaggggaaaatctgccctcatgatccaattacttcctaccaggtcccttccccaacactggaaattacaattcaacgtgcgatttggatggtgtgacacagagcaaaaccatatcaaccatactgtatgccaaaaaattagatgacctagatgaaatggacaaatactcagaaaaacacaaactatctaaagtgaccagtgaagaaacagaaaatctgagtagtcctgtaacaagtcctgtaacaaaactggattagtaattaagaaacttcccacaaagaaaagcccaggttcagtcttcactggtgaatactatcaaatatttaaggaagatttaatccttcacaaattatttcaaaacttggaagaggctggaaccctttccaactaattctgcaaagtcagcattaccctgatgccaaaaccaaagatatgacacaaaaataaaactgcaggctaatatcacatttgaatatagataactttctaaaaatctcaacaaaatgctagcaaacagaattcagcaacaaataaaaagggttataaagggtgaccaagtaggatttatctctggaatgtaaattaacattcaaaaacctaagaataggaggaaactttcttaactttgtaatggacatctctgaaaaacacacagctaacatcatactaaatagggaaagattgaaatttttccttgtaagatcaggaacaagacaaggatgactgttctcaccatttcaatttaccattgtattgtagattcaagtcaaggcaattaggcaaaaaaaaaaaaaaaaaaaaaaaaaaaaaagaaagaggtaaaaggcacccatattggaaaggaagaggtgaaaatatctatattcacagatgacatgatcttatacaaagaaaaccttaaggaatccatgataaactattaaaacgagtaaacgagttcagcaaggtttcagaatacaagattaatgtgcaaaaatcaattgtatttctgtacactagcaatgagcaatctgaaaatgagattaagaaaacagttcactcacaatataatcaaaataccagaatacttaaaaataaatttaacaaaagaagcgtaagacttgtatgctgcaaaccacaaaacactgtggaaagtaattaaaaatctaaataaatagaaaaacatcccttgttcatgtactagaggactcaatattgtcaagatggaaatactccccaaagattgaaggaaatccctatcaaaatactggctgttttcttagcagaaaatgaaaatctgaccctaaaattaatatttaaatacatggaacctaggataaccaaaataatattgagaaagaaaaacaaagtcggcgtacccatgcttcctgattccaaaccttattacaaagcagtggtaatcaagagtgtatggtattggcataaggacaaacagatcaataaatggaatactattgagaatccaaaagttaactcttacatttaagaccaattgactttcaaaagtgttgctaagacatttcaatgaggaaagaatagtcttttcaataaattgtactggaaaaattggatatccacatgaaaataaaagattttggaccacttcaaacctgcaaaaaaaataaaatgatctcatggtgtatcatggatctaaatgctatagagctaagatgataaatctcagaagaaaatatcaaagtaaatctttatgaccttgaagtaggcaatggttttttggctataacaccaaaagcacaagcaataagagaaaaaaaatttttttaaaaaaacccttgattattttattaaaattttgttgtgggtacaaagtaggtgtgtatatttatggggtatatgagatattttgatacaggcatacaatgttcaatgatcatattaggataaatgaagtatccagtacctcaagcatttatcatttgtgttacaaacaatccaattatactcttttagttatttttaaatgtacagtacattattattgtagtcattcccttgtgctatcaaatactatatgttattcattctatctaactatattattgtacccattaaccatccccactcccctgcctcccagctacacttcgtagcatctggtaaccatgatttcctcttatctccatgagttcagtagtttcagctcatggagatagacagaactaattttattagctcccacaaattagctcccatgtcagaacatgtaaagtttgtctttctgtgccaggtttatttcacataacataacgaactctagttccaaccatgttggtgcaaatgacaggctctctcttttttttttttttttttttttttgagatggagtctggctgtctcccaggctggactgcagtggtgcaatctcagctcactgcaagctccgcctcccaggttcatgccattctcctgcctcagcctcctgagtagctgggactacaggcacccgccaccatgcccgactaattttatatatatatatatatatatatatttattattattatactttaagttttagggtacatgtgcacaatgtgcaggttagttacatatgtatacatgtgccatgcaggtgcgctgcacccactaactcatcatctagcattaggtatatctcccaatgctatccctcccccctcccccaccccacaacattccccagagtgtgatgttccccttcctctgtccatgtgttctcattgttcaattcccacctatgagtgagaacatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaatgaacatacgtgtgcatgtgtctttatagcagcatgatttatagtcctttgggtatatacccagtaatgggatggctggttcaaatggtatttctagttctagatccctgaggaatcaccacactgacttccacaagggttgaactagtttacagtcccaccaacagtgtcaaagtgttcctatttctccacatcctctccagcacctgttgtttcctgactttttaatgattgccattctaactggcgtgagatgatatctcattgtggttttgatttgcatttctctgatggccagtgatggtgagcattttttcatgtgttttttgggtgcataaatgtcttctttttagaagtgtctgttcatatccttcgcccactttttgatggggtcgtttgtttttttcttgtaaatttgtttgagttcattgtagattctggatattagccctttgtcagatgagtacgttgcgaaaattttctctcattttgtaggttgcctgttcaatctgatggtagtttcttttgctgtgcagaagctctttagttgaattagatcccatttgtcaattttgacttttggtgttttagacatgcttttggtgttttagacatgaagtccttgcccatgcctatgtcctgaatggtaatgcctaggttttcttctagggtttttatggttttaggtctaacgtttaagtctttaatccatctcgaattgatttttgtataaggtgtaaggaagggatccagtttcagctttctacatatggctagccagtttttccagcaccatttattaaatagggaatccttgccccattgcttatttttgtcaggtttgtcaaagatcagatagttgtagatatgcggcattatttctgagggctctgttctgtttcattgatctatatctctcttttggtaccagtaccatgctgttttgattactgtagccttgtagtatagttagaagtcagggagtgtgatgcctccagctttgttcttttggcttaggattgacttggggatgtgggctcttttttggttccatatgaactttaaagtagttttttccaattctgtgaagaaagtcatcagtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgaaagttggattcctaggtattttattctctttgaagcaattgtgaatgggagttcactcatgatttggctctctgtttgtctgttattggtgtataagaatgctgtgatttttgtacattgattttgtatcctgagactttgctgaagttgcttatcagcttaaggagattttgggctgagacaacggggttttctagatatacaatcatgtcatctgcaaacagggacaatttgacttcctcttttcctaattgaataccctttatttccttcttctgcctaattgccctggccagaacttccaacactatgttgaataggagtggtgagagagggcatccctgtcttgtgccagttttcaaagagaatgcttccagtttttgaccattcagtatgttattggctgtgggtttgtcatagatagctcttattattttaaaatacggcccatcaatacctaatttattgagagtttttagcatgaagcgttattgaattttgtcaaaggccttttctgcatctattgagataatcatgtggtttttgtctttggttctgtttatatgctggattacatttattgatttgcgtatattgaaccagccttgcatcccaaggatgaagcccacttgatcatggtggataagctttttgatgtgctgctggattccgtttgccagtattttattgaggatttttgcatcaatgttcatcaagcatattggtctaaaattctcttttttggttgtgtctctgcccgtctttggtatcaggatgatgctggcctcataaaatgagttagggaggattccctctttttctattgattggaatagtttcagaaggaatggtaccagttcctccttgtacctctgatagaattcggctgtgaatccatctggtcctggactctttttggttggtaagctattgattattgccacaatttcagatcctgttattggtctattcagagattcaacttcttcctggtttagtcttgggagggtgtatgtgtcaaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccacctcctggattcattaattttttgaagggttttttgtgtctctatttcctttagttctgctctgattttagttatttcttgccttctgctagcttttgaatgtgtttgctcttgcttttctagttcttttaattgtgatgttagggtgtcaattttggatctttcctgctttctcttgcgggcatttagtgctataaatttccctctacacactgctttgaatgtgtcccagagattctggtatgttgtgtctttgttctctttggtttcaaagaacatctttatttctgccttcatttcgttatgtacccagtagtcattcaggagcaggttgttcagtttccatgtagttgagcggttttgagtgagattcttaatactgagttctagtttgattgcacggtggtctgagagatagtttgttataatttctgttcttttacatttgctgaggagagctttacttccaactatgtggtcaattttggaataggtgtggtgtggtgctgaaaaaaatgtatattctgttgatttggggtagagagttctgtagatgtctattaggtctgcttggtgcagagctgagttcaattcctgggtatccttgttaactttctgtctcgttgatctgtctaatgttgacagtggggtgttaaagtctcccattattaatgtgtgagagtctaagtctctttgtaggtcactaaggacttgctttatgaatctgggtgctcctgtattgggtgcatatatatttaggatacttagctcttcttgttgaattgatccctttaccattatgtaatggccttctttgtctcttttgatctttgttggtttaaagtctgttttatcagagactagaattgtaacccctgccttttttttgttttccatttgcttggtagatcttcctccatccttttattttgagcctatgtgtgtctctgcatatgagatgggtttcctgaatacagcacactgatgggtcttgactctttatccaatttgccagtctgtgtcttttaattggagcatttagtccatttacatttaaagttaatattgttatgtgtgaattttatcctgtcattatgattttagctggttattttgctcgttagttgatgcagtttcttcctagtctcgatggtctttacattttggcatgattttgcagcggctggtaccggtcgttcctttccatgtttagtgcttccttcaggacctcttttagggcaggcctggtggtgacaaaatctctcggcatttgcttgtctgtaaaggattttatttctccttcacttatgaagcttagtttggctggatatgaaattctgggttgaaaattcttttctttatgaatgttgaatattggcccctactctcttctggcttgtaaagtttctgccgagagatctgctgttagtctgatgggcttccctttgagggtaacctgacctttctctctggctgcccttaacattttttccttcatttcaacttttttgaatctgacaattatgtgtcttggagttgctcttctcaaggagtatctttgtggcattctctgtatttcctgaatctgaatgttggcctgccttgctagactggggaggttctcctggataatatcctgcagagtgttttccaacttggttccattctccccgtcactttcaggtacaccaatcagacatagatttggtcttttcccatagtcccatatttcttggaggctttgctcgtttctttttattcttttttctctaaagttcccttctcacttcatttcattcatttcatcttccatcgctgataccctttcttccagttgatcgcattggctcctgaggtttctgcattcttcacgtagttctcgagccttagttttcagctccatcagctcctttaagcacttctctgtattggttattctagttatacattcttctaaatttttttcaaagttttcaacttctttgcctttggtttgaatgtcctcccatagcttggagtaatttgattgtctgaagccttcttctctcatctcatcaaagtcattctctgtccagctttgttccgttgctggtgaggaactgcgttcctttggaggaggagaggcgctctgctttttagtgtttccagtttttctgctctgtttttccccatctttgtggttttatctacttttggtgtttgatgatggtgatgtacagatgggtttttggtgtggatgtcctttctgttttttagttttccttctaagagacaggaccctcagctgcaggtctgttggagtacccggccgtgtgaggtgtcagtctgcccctgctggggggtgcctcccagttaggctgctcaggggtcaggggtcagggacccacttgaggaggcagtctgcccattctcagatctccagctgcgtgctgggagaaccactgctctcttcaaagctgtccaacagggacatttaagtctgcagaggttactgctgtctttttgtttgtctatgccctgcccccagaggtgaagcctatagaggcaggcaggcctccttgagctgtggtgggctccacccagttcgagcttcccagctgctttgtttacctaagcaagcctgggcaatggcaggtgcccctcccccagcctcgctgccaccttgcagtttgatctcagactgctgtgctagcaataagcaagactccatgggcgtaggaccctctgagccatgtgcgggatataatctcctggtgcgccgttttttaagcccgtcagaaaaacgcagtatttgggtgggagtgacccaattttccaggtgccgtctgtcacccctttctttgactaggaatgggaactccctgaccccttgcgcttcccgagtgaggcaatgcctcgccctgcttcggctcacacacggtgcgctgcacccactgacctgcgcccactgtctggcactccctagtgagatgagcccgctacctcagatggaaatgcagaaatcacccgtcttctgcttcgctcatgctgggagctgtagacctgagctgttcctattcggccatcttggctccagaaaaaaaaattgttaaattggacttcatcaaatttgaaatttttgtgctgcaaatgataccatcaagaaagtgaaaatctcacccacagaatgagagaaagtatttgcaaatcatatatctgataagggtattgaatttagaatatataaagaactcttgcaactcaatataaaaagacaacccaattttaaaatgggcaaagtatttgaatagaaatttcttgatagaagatatacaaatttaaaaatgctcaacatcattagtcattagggaaatgcagatcaaaaccaaattgagataccggtttacacctattaagatggctatagaataaaagaacaaataacaagtattggctttaatgtggaggagccagaacccttatatattgctggtaaaatgtaaagtcatgcagccctttgaaatacagtctgcaagtctttaaaaaattactatttgttatttggtttttcttcacttttaatttaggttcagaggtacatatgcaggtttgctatatagctaaattgtgtgtcacaggagtttagtgtacacattatttcatcacccaggtaataagcatggtacccaataggtagtttttctatcctcaccctcctcctaccctccaccatcaagtaggccctggtgcctcttgttcttttctttgtgttcatatgtactcaatatttagcttccacttatcagtgagaacatgtggtatttggttttctgttcctgctttagtttgcttaggatactggcctccagattcatccacgttgctgcaaaggacatgatctcattctttttgcatagtatactatggtgtacatgtatcaaaaatgttactgtttgacctagtaattctattccaaggtaaatactcaagagaaatgaaaacatgtccacacaaatacttgtacacaaatgttcattgcagcattatttataatagccaaagagtggacgacaaatgtcttccaaatgtgggctccaaatgtccaccaactgataaatggaaaaacaaaatgtggtatatccatgccatggtttatctgtcaataataagaaatgaagtactcatacatgctccaacatggatgaaccttgaaaacattatgctaggtgaaaaaagcaactcacaaaagactacactgtatgattttatttgtattaaatgtccataaaagaaaaatatttagagatagaaaggaaattagtttttccagggtctgggaggagacagtatgaggagtggctgctaatgggtacaggatttctttttggagtgatataattgctctaaaattagtttgcagtaatagatgtgagtatgctaaaatgggtgaattttatagtatgtgaaatataactcagtaagcccattaaaaacaacctaattaaattaaaaccaagctataacagaaatattatatggctttggcagtttagaatagtgggaaaatatggagtaagggtggggaaatagtcccaagtataattctggttttgtcactactagtgtatggacttggacaagtcatttgctttctctaagtatcagtttgcatatatgcaaaatagaggtaatgatacctacctcagtggtaccttttcaaaaccttgttcttcctcatctctcctctaccactttctcataatattattacagtaataaccatttattaagcactgtgtccgcagtggtgtggggctgctttacctccacaacttcactgaatcctcactgcagtcttgtgggatctttatttctttgcccattttacatgtaaataaattgaagtcaaatgagttgttcaaggtccttctgttagcaagtggcagagatggacatgaaaactagatcttctacctatgtgtctttccacttcaactaaagaatttattaaagagaattgaaaagctatgaactaaatttcggtaatacttttaatagtaaacattgctgccctcgtgaatgaacacacactaaatttcaaatctcacggtggcagggaataaagatgctacctatcttaagccattacttcaccaacttctccaccaaaatattccttgtaaccacaaataagtaagcacaatagatctataaggagagaataattgtgaactctgattttatcttaaaaagtcatgtagggatgtcatgttccacaatgtgattaataaaatatattttgttactaaacacaaggaaaaatattatgttccataaagatgtttggtggttgcctcgacctcttttagtttgaaaagtaggtatgtatgagaaagatatgtgtttacatgtttacccttgccttctctctgtctcttcccctctctctccctccctccccaacccctatgccctacacccccgcaacccccacatgtatttacctttctctaaaagctctgcatagccaagaaaagtgctcttttttatttttaggatattagatatttcattttcttatggtaagacaaaagattaaggcaaccaagacttacaatgtgcctaccatgtggcaggcacagaggcaagggcttttacatgttatttaatgtaattgtaattctcacaaaagccgtctagagttgaaaatatttccaactctaaatgaggcaaatggagcacagagagccttaattatttcacccaaagttcagtggtagaggcaggattccaacccaggtctggtgggctccaaatccttgttgggttgccattcctcttgctaacaaataaaactggtctgtgacttttgcatttcaccccgcttccacagtcactggtgggacttacttaagttaatcagattcttcaaagtatccccaagtcctcctttgaaaagaaagttgggggacaggaggaggagcagaggagaggagataaaaaggaaaggagtcagggagagagagagagagagagaaacctggtgatctcagctgggtgccaaggtttcctaagcccaagttccccatggttgagcctgtattgtcaggccaacagcttctagtaatccacttttatttaattaatagtgaaactgttgaagaattgcaagtggtgttctggttcagaaaccttccgttctatggggcactgcttttgcttcagattcataaaaccaaatgctctgcctcaagataataagtgaacgtgtaaccctcgggaggtaagaaaaaacacaatgtcacgtgcaaattctgcacttgttctcaaagcaaacctctcctgtgtttgcaattaggatgttatctaggagcatattcaaaacttttgaggtttttattttagtttttctttcattatgtgctgttttagtaatatcaaagaatacatgtaatatataatttatatgtcataacaataaaattaatgttgatgagcccagattaaagaatcaacaacattaacatcatgattgcatcaaccctattagaatggaagctctgtgaaggcatggatttttgtccattttgttcactgctatatccccaggacctagaggagtgtcagccacataataggagcttagtcaatattttaaaaataagagcataaatctacttatatcctctttcctcttaccatcactcccagcctcccctcagaggtaaccactatcctatatttgggctttattattcccttgcattttgataagttttcacatgtatattcccaaataatatattgcttgcttttgcttctttttaaactttatataatggaatcatattgtatgtatcctattgtgaattatgtcttttacacaacattagtatttgagattcaactatgtgtagctcgattccattccttttcattgctgattgtagtttattggatatgtgtgccataaattatttttctcctgtcagttaatgtttatcatttatgctttaataaacaaaactgctatgactgttcctgcatgtgcctcctagtacatatgtgaccaactttctctaggatataagcctgagagagggactgcagttggaatttacatttccaaagcccaaagtttagctcatgagtcagagctgcaatgtgccctttgtccacactaggtcaggatcagtgggagtgctacccaaaatattttgctagctggggagtcagggagaagcagagactgacctagtgaggccaggaggcactatctcaggtctctagtcaaaatgggttgcaattagtaaaagtccagattctgaatccccttcactatttatcttcctcttcctcctttacagttatttttgttcaaggtgcactttattaaactcatgcctaacaaacaaaactctaatgaatattttgtctttcattgattgtaaattcaattaattagattgcttgaaaaaattttaactgtattttcactttagtatggatgaaaatttcgatttctttaaaaaacattttttaataataacacaacataaagtctaccctcataacaaaatttaagggcacaacaccatattgttttttttttattttattattattatactttaagttttagggtacatgtgcacaacgtgcaggtttgttgcatatgtatacatgtgccatgttggtgtgctgcacccattaactcgtcatttagcattaggtatatctcctaatgctatccctcccccctccccccaccccacaacagtccccagtgtgtgatgttccccttcctgtgtccatgtgttctcaatgttcagttcccacctatgagtgagaacatgtggtgtttggttttttgtccttgccatagtttgctgaggatgatggtttccagcttcatccatgtccctacaaaggacatgaactcatccttttttatggctgcatagtattccacggtgtatatgtgccacattttcttaatccagtctatcattgttggacatttgggttggttccaagtctttgctattgtgaatagtgccgcaataaacatacgtgtgcatgacaacaccatattgttaactgtaggcacaatgttgtacagcagacgtctagaactttttcttcaggcttaactgaaactttatagccattgaacagcaacactccatttccgtttcttaaaggtcctttacaaaatgagctttctgcgtgtttccattttgtttatctgataacttttttttctttttttattatactttaagttctggggtacatgtgcagaatgtacaggtttgttacataggtacacacatgccagggtgtttggctgcacctatcaacctgtcatctacattagatatttctcctaatgctattccctcccttgcccctcacccctcactggccccagtgtgtgatgttccctagcctgtgtccaagtgttctcattgttcaactcccacttttgagtgagaacatgcagtgtttgattttcttttcttgtgttagtttgctgagaatgatggtttccagcttcatccatgtccctgcaaaggacatgaactcttccttttatatggctgcacaatattccatggtgtatatgtgccacaatttctttatccaatctatcattgatgggcatttcagttgttccaagtctttgctattgtgaatagtgccacagtagacataagtgtgcatgtgtctttatggtagaatgatttataatcctttgtttatatacccagtaatagaaatgcttggtcaaatggtatttctagttctagatccttgaggaattgccacactgtcttccacaatggttgaactaatttacactcccaccaacaatgtaaaagcgttcctatttcttcacatcctctccagcacctgttgtttcctgactttttaatgatcacgattctaactggcgtgagatggtatttcattgtggttttgatttgcatttctctaatgaccagtgatgatgagctttttttcatgtttgttgaccgcataaatgtcttcttttgagaagtgcctgttcatttccttcacccactttttgatggggttgtttgtctttttcttgtaaatttgtttaagttcattgcacattctggatattaattaacctttcgtcagatggatagactgcagaaattttctcccattctgtaggttgcttgttcactctgatgatcgtttcttttgctgtgcagaagctcttgagtttaattagatcacatttgtcaatcttggctcttgttgccattgcttttggtgttttagtcatgtagtctttgcccatgcctatgtcctgaatggtattgcctaggttttcttctagggttttcatggttttaggtcttacgtgactcatcttgatttaatttttgtgtaaggtgtaaggaaggggtccagtttcagttttctgcatatggctagctagttttcccaacaccatttattaaatagggaatcctttccccattgcttgtctttgtcaggtttgtcaaagattagatggttgtagatgtgtggtattatttctgagacctctgttctgttccattggtctatatatctgttttggtaccagtaccgtgctattttggttactgtagccttgtagtatagtttgaagtcaggtagcatgatgcctccagctttgtgcttttggcttagaattgccttggctatgcaggctctttattggttccatatgaaatttaaagtagtttttttataattctgcgaagaaagtcattggcagcttgatggggttagtattgaatctgtaaaacactttgggcagtttggccattttcatgataatgattcttcctatccatgagcatggaatggttttccatttatttttgtcttctcttatttccttgagcagtggtttgtaattctccttgaagaggtccttcacatcccttgtaagttggattcctacatattttattctgtttgtagcaattgtgaatgggagttcactcatgatttggctctctgtttgtctgttattggtgtataggaatgcttgtgattttcgcacactgattttgtatcctgagactttgctgaagttgcttgtcagcttaaggtgattttgggctgagagaatggggttttctgaatatacattcatgtcatctgcaaacagagacaatttgacttcctgttttcctatttgaatatcctttattgctttctctttcctgattgccctggccagaacttccaatactatgttgaataggggtggtgagagacggcatccttgtcttgttctggttttcaaagggagtgcttccagtttttgaccattcagtatgatattgggtgtgggtttgtcataaatagctcttattattttgagatatattccatcaatacctagtttattgagagtttgagcatgaagcagtgttgtattttgtcgaaggccttttctgcatctattgagataatcatatggttttgtcattggttctgttgatgtgatggattatgtttattgatttgtgtatgttgaaccagccttgcatcccaggggtgaagcggacttgatcgtggtggataagctttttgatgtgctgctggattgggtttgccagtatttttttattgaggatttttgcactgatgttcatcagggttattggcctgacgttttctttttttgttgtgtctctgccaggttttggtatcaggatgatgctggcccataaaatgagttagggaggattccttctttttctgttgtttggaatagtttcggaaggaatggtaccagctcctctttgtacatctggtagaattcatctgtgaatccttctggttctggactttttttggttggtaggctattaattacttcctcaatttcagaacttgttatagttctattcaggtatttgacttcctgctttaggcttgggagggtatatgcgttcaggaatttatctatttcttctagattttctattttatttgccccagaggtgtttatagtattctctgatggtaatttgtatttctgtgggatccgtggtgatatcccctttatcattttttattgcatctgtgattcttctctcttttcttctttagtagtctggctagtggtctatctacaaaatagactgtttatctgatatttattttgtaattatctaataataaccatcattatcatcatcagcattatcattatcatctcctttacccatacatacatttgtgtctttcaaataataatcccatctttgaagtgcatcctcatctttagcagtctgcactctgctttcttatatcatttattatcttattttataattatttatttccagtccttcttctctaacagatagtagtttcttagggccaaggaaatatctcgatcaccactatatccccagcacctaaccctgtgcctggtccatagggccagatgctaagagttgagttgaaccattgtacctaatcttaaccttcattagcacaacatggtttgtcagtggttaagaatctacactttggagtcagactcacccaggatggaatcctggcattgccacttattattaatagatgcgtgatcttgaacaagtttacttaattgttctgagcatcagtttcctcttctgcaatatagggatgatacacagctacctggtaggttgttgggaaaattaaatgggatgatatgtatgaaatggcctggcatatagagtgcctaaatacatgttcttctgattctatttggacagtttgtgttagtaacagaagtcaaaaaggtggagaaaggagaaaggtacttgtgaaaattttctatttcttctccatgtttcattcaggactgaggaagggggcacagtttttacccaaggaaatgacatttttagccaaaagaaatgatcttagcatttagctgaattatatattggaagtaagctccttccatgtggaacttatggccttgctagccttggtttgttggaagtgctcttgctggctttctagttagggtagggaaaggaaggcttgtggggaatgaagataggccatgatatcaagccactgggtttgcaaatcagtagaattttttattgctttctgttgtacttgggacttgaataaaggctgatatttgtgtcttgctggtaaagtgcttgtaaagtgagtgaaagttttctttgctcttgtcctgacatagctgttcacttggggttgaggggaggataacctttcatgttttttttttttcttcattctgatgactgtgctgaacattcaaaccaaaaggccattggtggaaagtaaaggtgagtggtgagaagacaatagggtaatggaaactgtgttggacttgtaatcaaattgtcctgcacttcccctctccaagtcttaacgtttttcatctgtacagtggatattaaaatgagaaaataagcttgtcttcacagagttttcgttaggtgttgacacaacaaacaggctcccattagggctcattttccttcattccttagtaaggaagaagtgcttataaaatatagcagttgtgctcttgtgaatgatagcatgggcagttgtcatctccctgaagcagatgtaacccagaatgtcacttgagttttgtttaatgcttaggcataagacataggaatgacaaaagctgacctttgggtagtgagaacaatgttccattttgttcaaacttgaattttttactataggagactgagaattaaccttccatgaaggttttaggattggctttctggcccttctccttcatatccacctgaaagagcttgggcgcagaagttcttgcagaaaggcagttagacaaggtgacttctgaagctccagtggccaagtattttgatggtagcctaaaagatgtccagaatcattgtacatcattttttcaacagaagcttcaggcatagggattatgcttggtactttatgttgtggaatggaatctggcggatgtccatgtgatctatagaaacacctaaggaaagtgaagaaatgagggaaaaaaaagaacaagacttttatgataatactaatcacgatccttgtgtatttattccaatggcattttatccattatctgatttatattaccactcacagcagcagctcaataggatgggagatattatctctattttatagatgagatttgaggctcacgaagctaaagcaaggaacatcaaatcactttgatatttggtctggttttgttataggtctccctttggatgaggtaaagttacaaacctgggttcatatcatttaattagtctgaaaatgttgcctggacaccaccttcagttagatatcttaacctcaggcttcctgccttcattgctcccgcatatagacatagactatgagattggctaatcccagagaacttccctaatcccttggcaagatccaaaaaggctcagtcacaccctacaaccatcatctttaggagaagtctcagaaaattcagcttcacactaactaacttgagcaatgaataatagtcatttatgcctgcaggttaatgctgaagacctgagacttcacttgcctatttctgccattcagtgacatgtgttgcattggttttttgtgtctttccagtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaaggtaaagggtcttgcacatgcacttctctttccctttctcctttaccttccagagagagacactaacctttcagggcccaggattttatcatctcagaaatagagtcattggcaaggccctatcaaataacttaggagcctaaggaagcaaatttttgtacttgctagttccctggtttcagcagccttgtttgtacaggcaatttaggcagtgaaggtggtcccagctggggcttggggctcagtgggtcctagaaatgaaagaaaaattaatgatttgaaaagatttaatttcctcccttcttgttttctactctgctggctagtaaaggaaaaatttgtccttattagagaggttagaagtggagaaaccccaactgagtccccagcctgttccttgggatgaatatgagactgttccttagcaaaggcttcctggcctcggccccagaaagggagtgttctcactcttcagcagactatcagtctctgcacctgctccctcctgttgtggcctccttgggacctgtctttgcattaatagttcctaggtaggtaagaactcagagtgaagaaacacatttattctcctctccagagacctgatctcaaagcctgtccattagtccctaaccttaatctaaggtagcatcttatatctggctaaattggctcaagccctagctccttagttttatttagcttagaacaactcatgtctgctcaacctctagaggcgctcagcccacattctgcagtagaaactcccattttcaggcctcttatatacggtaatgtctccttcctctaaccacccagggcttaagcttcctgcttatccacttcaccctgtattgagggctttcttctcaaagagacattgatgaggagcccctagagagagatgctgtgctctgggaccagaccccttgttaaacaccagtattcacctctgccccaactttccccaaagaggtacttcctgccaaggcctttctctttcctctcactggctggaagtgttgagttccacttcagaaccagaacagagaacctttccttctataagagctataaaccttgagaacagtcttaaaacataggtatgtaggccacaccattcaccacgaatgtactgatactcatcagaatatggaagaagcaccagagagtttgaagcatctagagaaaaggtagaaagagaatgccctttaactgacctcctcagtgatagccaatcacaatgatgagtgttgattcatcattttggctaggtggcagaaatatctataaaacagaagctgccatgttgttttcttccagtcctcagggcctacaagaaggcagctatcatttggtattactgaaaacatgccccatgttcagctcatacccccaaattacccattgctactgtttatgctgggctaatatgaagcccagggccctaatgtctaggtctaggcagtaaggcctagagcagtgcctaaagagcctgagagcagtgccttcctttcttcagagtactcatgaaaggatggctgtcagaaaaggaaatgaggatgggttccagagacttcagaccaccccaacttccccagtgagaccctggcacctccccataccctctcacctagcgggccctgtctatagagcagagaatgaaacagagcactcatctagaggtagtgtgtcagcaagcccaggcactgcaccacagtaatagcagccatatcagatgggaaaggagttcaagtgaacaaacaagcaaattcaatagtcagatagattagattatacttgatgcttcctctgagttttacaaatatgggtcactaaattgttattttcagaaaacaggggaaatgctcaatcacattgtgaaagggaagattttgctgtcatatcatacatcccacatgggagctttctgcagaagttagagctgaaggagggaggcaggcagaagggcaactggcagggctgcctgggaggagctctgcaatgaggtggatcctgtgccatttgagaacagggaagaaaagaaatgaggttttggggagggaatcacccaactcacagaacacacagaaatccagcaaggtttcaaaacgctctacaccttagagtctgttaagttagggaaactctgtgagctcatagggccaaatgcacttgcctgcttgaaatatgaaaaatcagcaatggattccttgaaaaacaatgaaaagggaaccttctgagccccttggttattttgacatatggaccatagatttcagtcctgagccctttgaaggtaggagaaggtggtttagaaaacacacacacacacgcacacaaacacacaccagaatgaagcaaaaaaaaaattactggtgttttctttctcctcccatctgtgaagctgttggattgattttactgccatcattatccctgtttgaaggcagggggctgtcttattacccaaagaggacatttattgatttggttttctttttccatttttacaatgcatctttatcgcccatatggcctttctggaggtggttttcagtctggcttgttgaaacatcaaattatacctgtcttagagaaaatagaaacaaaaatctttctcttccttacttgcttgttgtagtcagttaactcggactgagtattcagagtcttgattatcacttaattcatagtttcataaatctctggaatgggcataggtacaggacttaaaagcctggcatctcagacagaaatatgtttttagctttggtggtttataacagatgggacttttaggctgtcattggtgcagggctcagcacagagtcagttgtaatctggacaggttttgttgttgaggaagagtgggaagagggagtcctacattttctccttgtcagtaatgttggagaattggggtgagggtgaggctgggcagggagggtctgcatagaaaaaagggtgcggtgagaaaaaataatgctactaagccatgagggtaaaatgaccaaattctggttgagagaaacttggtcaaagtgtgtatggggagagaaagttggtcaaagtctgtgtctgagtgcttggtgggatgaactctgggttagaaacaggcatggagggaaatagttggtttatggagtgggtaggatgagtggggtggtgaaagggaaggcattttggatgctaagagaccaggaagtcaaagcaaggcaatacacataaacagaggtaagggctcagagaggttttagttgtgtagacttggataagaaattttcccttttggacctcagttttccttgtttgtaaaacaacggacttgaactagatattttaaaatgtgcttccagcttagacattttgtgaccgttctacaaattacaaacataatcatcatcatttcagcaaactcacatgtatttatacctgcataagtttttggtcttgctttcctagaaggtgactaatcccagatcctaatcaattaaagaagcaatcttcagatggggatagagccagctgagagagtgtactatggatggagtgagttaaaactcaggactcagattttctccttgtgatcattgctgggtaacttcctttcttttctattttctcatctggaaaatcaggatatgaatccccatctctacctcattatgtttcaaagagggttaattaatccatcatgtgcattatgtgctcaagaatttactatttttcagacattttctagtaaaacattgaagattatatgtccatttgttttgtacacatggagtgctgtttggtacacatcataaaattgaaactgtagtttacattctgaactcaaagaattacaccatcctcactgatgtttacaataggtcccaatttagtttctttagcaaattttatgtaagtatggctttgattctctctctcactccaggtttttgttagggaagaaatgcaagtgaaccctcattgaactctttctgtcctttaaatccattctttcccacctcaactcatgtggaattgaatgttgcctctagtttggagtctagcagagagtttttggtgcatatcagtgtccccttcactccctgacttttcaagtaacatttcccagaggcaaattaactctgctaagaggatctgcttgcagcttcaacagagccttcatcaggtatctttggccaaggagttgactgatcctgactttgcgagtcctagagatcttttcacaaagctcctctcatgtttctgcctctgattttcttaaatgtcacagacagactttagatttaggggttggttaactttttttgtaaagggccatgtagtaaatattttaggctttgtagatcatatggtctctgtgtcaactactcaactctgcctttgtaggatgaaagcagccatagacaatactggaactaatgggagtagctgtgttccaataaaactttatgggcactgaaatttgaatttcacttaattttcacatgtcgtttaatattatttttcttttttaccatttaaaaatttagaaatcattcttagctctttgggcctcacaaaaacagatggtagagtggatttggtttatgggctgcagtttgttgacctgtgctttagctaatcacttctgtacttataaatctgcataggttttatgtttttccatctcttggtatcttagtaggccagtcaaagtttgaacaacttgttagcacagaatacctggcctagtggcttcttggtcctgagcttatttactaaacaagagaaaaaataaataagtctagaaatgctagaagaggatacttttttgttttaatgatctagtagatcactcctccttgcaatacccagaggagaaactgaaaatatttcaaacattttctagacttctgtgttgtaaatttgtggataactatgaactatatatgaatgaacttttctggatgacacatatattccagatggtaaaaaggaagggctttggggactctctggtaccaagtgtcatggaaaaactgtgtgtctcatagaaagtagatcccaggaggccagcagagttgtggatctgccatatattacctcatgattctgtcttcgcacactcaccggcttaattctgggcctccccataacacgactagaccacaggcttgcagaagaaataatttagctctgtaactcattgaagttggtgcccacccaagtctctgtcagtgcccaattcgggagccatgccaagaatttgccattgctgcttcatggtggccttgtgcctgcttatttatagcctgtgcattttatgaaacagggattaataagaagttgccatagcacttgcaccattatgtaaatatctgtaatgcttacataacttttgtcacttgcaagaccttttgagtccattgccttctgctaccatgccttaccaatttcctagtcccttattattatttttcaattcattatatttaacttctgtgatacacgttcagaatatgcaggtttcttatataggtatacacgtgccgtggtggtgtgctgcaaccaacaacccgtcatctacattaggtatttctcctaatgctatccctccactagcccaccaccccctaataagccccagtgtgtgatgttcccctccctgtgtccatgtgttctcattgttcaactcccacttatgagtgagaacatgcagtgtttggttttctgttcctgtgtttgttttctgagaatgatggtttccagcttcatccgtgtccctgcaaaggacatgaactcatccttttttatgactgcatagtattccatggtgtatatgtgccacattttctttatccagtatatcattgatgggcatttcggttggttccaagtctgtgctattgtgaatagtgctgcaataaacatacgtatgcatgcgtctttatagaagaatgacttataatcctttgggtatatacccagtaatgggatggctgggtcaaatggcatttcaggttctagatccttgaggaatctccacactgtcttccacaatggttgaactgatttacacccccaccaacaatgtaaaagtgttcctatttctccatattctctccagcatctgttgtttcctgactttttaatgatcgccattctaactggcattgacatggtatctcactgtggttttgatttgcatttccctaatgaccagtgatgataagctttttttcatatgtttgttggccgcataaatgtcttcttttgagaagtgtctgttcatatccttcacccactttctggtgtggttggttatttttttcttgtaaatttgtttaagttccttgtagattctggatattagccctttgtcagatggatagattgcgaaaattttctctcattctgtaggttggttgttcactctgatgatagtttcttttgctgtgcagaagctctttagtttaattagatttcatttgtcaattttggcttttgttgccattgcttttggtgttttagccatgaagactttgcccattcacaattgctacaaagagaataaaatacctaggaatacaactcacaagggatgtgaaggacctcttcaaggagaactacaaaccactgctcaaggcaataagagaggacacaaacaaaaggagaaacattccatgctcatggataggaacaatcaatatcgtgaaaattgccatactgcccaaagtaaattatagattcaatgctatccccattaagctaccattgactttcttcacagaattagaaaatactactttaaatttcatatggaaccaaaaagagcccatatacccaagacaattctaagcaaaaagaataaagctggaggtatcaagctacctgacttcaaactatactacaaggctacagtaacccttatcaattttttatgtgcctctccatattctgcagtcagaagcttcttcagtcctttcagggaattgctgggtgactatcaaactctggtagttcatttttgcagttggctgctgttgtgaggataagagttagactcactttctcttcagagatagaaattatgtattaattctctgggttctagacccacagcaaggagcatactgctcctcaaaataactgaattctgcgagaagccatcattgtaaaacaacaatatcttcagttatagtagccatgtgtgcaacttctggaaactgttattcagattttcatgttccttccctgtctcttcatagctaggcagctgctttcagccttgtacagatgctagtgagctttctacctacaaacctgcagaaaattgaactgagatttggaggtgaaagactcttgataaagggaacaaggtttagaattctcagtccctttgctcccaggctgtgttgtgactactgaggcactccagtgaaatcactattcctcctatctagactaatgcctgtctctgcagagcacctcataagaacaggcctggtagtaatatcctcatgcattcagtcagtaaatatttacagagtgcttactacatatagggtattgggctgacatatgcaagatacagggcctgcttccaggaggttatagcttattgatcataaatgtggcattttttttttttgagacggagtcttgctctgtctgtcacccaggctggagtgcagtggcacgatctcggctcactgcaacctccacctcccaggttcatgtgattttcctgcctcaccctcctgagcagctgagactacaggggctcatcaccacacccagcttttttttttttttctgtatttttagtagagacagggtttcaccatattggccaggctggtctcgaactcctgacctcgtgatccacccacctcagcctcccaaagtgctgggattacaggcgtgaaaatgtggcaatctttaaagctcttcagtggatgaaaggccaccctatctgctgtccttttgaacttcgcaactttcttggtacagagtgagaggttattctcttggttttccatataagtaaactgaggctttgccagttcatcaacaggtagtaaataatatatttggaatttgaacccaagtcttctggggtcaaaggcagcattcactctgctctgtcacagcagctcctcaaataagccaacatagaaaccaagtactatgcctaggcaacaagaaaggcagcaatgaagagcaacagcagagtcaaatatgagagaaggaagttaagaaagatgttaagtactgtggggagtaactgagaaaccaccaagtatcgctaacatcacagggaacttgtcttcctaagaaaattccaagcacttaaaaccgctggtagttcatcagcaactctcttcattagatgtgcgagggacatgtgggccatagtccttctactaacttatattcttcaggggaaagttctgattctgatgagacccagcatggtagctcttaattcactgttgtcacacgactatagaacaggaagcacaacttaacacctgtgctcatgagaattttgctccttatgaccaagctaaagaaagagcttagacaggatgtgtggctataaatgtagattaatggttccttggctctttggtttgagccttctcagcagagcatcccacggagtgttttccatggggccacgagcaagagaaatccacttccctcctcctcaatgtcagaaaatagagaatattgtctttcaggatagaattaaaaagtcatagaggcagcaacttgttttcctatattagggttttaaaattctgtttttccttcctctcctgggtcagatcattgtgtggatggaccttgatttcattgtggtatctgtatgtggaccctgaagaccatggacttctaacaattccttaagttacataagcacattcctacaggtcacaagctcatttacttacaggatggttgatttggtcacaggttatttcatgaaaatacttaaaagatttgcagtgttcaaaactgcagtatctttaaacactaaaacttgaaggaagggaatttagaaatcaaaaaatctggtcaaaccatttcatggaaaaggaaagtgaggctcagagagaggaaattactttcctgggtttgtatagcctataaatggcagaaatgagagcctccctgccatttctagttttctgtctgagagactctcctgcctaatagctaattagcagagtcacagaggtcattaccttgcaattctcaagaattatgtgaggcagcatagtaagcatttatggcccttggttcctagaaggagcttagtccctgatagtcatctctgcctttgccattgtgtgagactgtcttctgtaactgtatgtcttcctccctagtaagttaatgagtaataaaggtattctatagtgagaggactctgtaagacatttcttggtgtgaggattgttccaaggttgttttgtgtgtatgtgcatgtataaacttttttagggagcatattcatagcttttacatggatctcagaggctctataacccagagaagattacagaataccagtcttgtctttggtaaggattttatagacccatcctgactacagtgatatccaacatggctatgtaatgactggcactttccccacataacatatatttattccacactcagtgcctactgtgtacatgagacctataccgggcactgggataagagacatgaaataacagctaaaattgtttattgagcagtcagtatgcattagatgctttgtagtcattttcttattcaatctgtataccctcaatttacaaatgaggaaactgaggcacagaagagttgagtgatttgcccaaagtcatacaaatagtcagtggctatgtgatgaatagttaccaacataaaagagtgagattactgctgtactaaaagtaggtacataatcccctgagcagacagtatgagagaatgatttattttacctggaaagtttaggaaggcttcacagaggagttaagggttgatctgggtcttgagggatggataagagtttgccagatacaaaaaggtaggaagagaacttcaggaggagggaacaggctgagcaaagacacggcgatgtgaaagtgggaggcttgtttggggaacattatggaatctggaggttattgtggggaatctcatcagatgcagcaagctgtttgacaggccttcagttggctctttgtaccttgctccctccgcatgctgagctgtccatagctgccctaggctggtgtctgggattttcggaagaaggttactatccaggtagtgtaacaagatgcagtgcaaaagcaccagattggggctctggctctgctgctgacttaccacctggccttaagcatgtctagttccctctttgtacattaaaatctccattggaacagtaacatggttgtattaaatgatcttgaagattttacctgcacgttttgcacatgtaccctaaaacttaaagtataataaaaaaattaaaataaaaaataaaaatataacaatataaatctttaacaataattttagtagtaaatctctacaattttacagataatccagatgcatccattggccaatggttcactttgtatgcataatatttgggaaacaggcagacccaatttcaatccttagttgtaagacttaatacatatgtgatctcgagcaaatcacttttgtatgcctctataaggataataatagctcacagaattattttaagaactaaatgatgtgtaataaagctactggtactcagtaagttttgtatccttttcctagagtgagtcttggtcataggcatgcgtatacttgcagcgtccctgggtaggccgaaagagcaaataagagatggtatctatggtattccccaggtaaaggaggccttgggttggcataagatttcacttctctttagagttacttaattagggaccagaaaggccatcagcatttgtatgagaatataacaaaggtcaatctcttcctctttactttttacctcccagtacactgtgagtaacattccccagccagcccagccagcacgtgttcattgcctctcttgacttccagactttggacttgaaggtgtcagagctctctgtgtatctttgtccccaacaagataagtctgacctccccagcaaattcaagtcctaagccactgtccaggagaaaagctagcaaggtcataaattattctccatattttccagccattggtttcccttgtccagccagaggtgtgtctcaaagtatgctgaggccagattcaatagaaacctgagccagcacctgtgtaaataatttttaaagctccttttcctgaagctggatgaatatttttaaaaactaagctggattgtcttttatctagcatgccgtctcctacattcctagtgctatggacctcttggaggaatgtggtttggttatagtggtattgtcttgtctgttgtgggggagggagacatttctttcagaagcaaggtaatactttggtctggtctatgactctattttgtttaaaatgaaactatggcagtatagtggtattcattctgcttcccataggttaactttacatccctctgtcttcacccactcttcagttctgattcttttaaaagcagccaaccaaaaccagcaagtacatactgcttatctctgacttccaccagaatcaacttcagatcttgtccaaagctccatctgaagagaggggaataacacccagccaagagccctcagggcccatcagtaagtagacatcctgtccttgaggttccttaactctgctcagcttcagaatacagaaggggttggttcttcatttgtgttgtttataactaaaagcctcctactccccacttttttgcatagcttcttctgccatcccacctgtgtagcctcttcaactcccccaaaactcctctgtagcccatgtcacttggaaagagttttctttgtctcttttgcaacttgacaatgactagccagcaagtttaagttcaaattattgttccatgggagcagagatagatataggaaacaaaaaaaagggatatggaggtatagagtgatttcccacctacctagtgagcactactgagatattcaagtactctctacccaagaattctattgatataaaggtaaaaaacttgatcttaggtctaatatccgttagtagtgtgaccttgggaaaatgataccacccccaaaggcttagttttcttaactgtaaaataggcatacagatgaccacccccagaggattcataaggataacatgagataaggcaacttgaaatttcctagcatagtgatagactttcgaaaataaaatgaatcaaacactgataacagtacttcctagtacacaaatgagaaatcagtccctcatcaaattacagcacattttcaatgctccaattatgtcactgtagaaatgctaatgtggattaaataatttgtctgttgctatttatacggataatttgatagtagttatttttggacatggatagctttgaagccttacagatgagtccatccccaagtacccaaaactaaagaaagttggctagagtgatgacaaggtggcagcacagagctccctgcgttctgggccctgtcccctagctagagagaactccaggctataagcatttgtattctcatagtccaatggcagggaagaagggctggaggtgagtagttttcactcatttattttttcaacaagcatgtatggtatcaggccttgtatgcatccagagacaaatgtgaactagccgtgtcctcaaggagattccagtctggtgggcctgccttccaaggtcagttgcagctttagcactataaagagcacctacctgcggcagatacaatgtgatgggacatgacagagaaaaaatctataagcagagcctccccattcccaggcattgaaacaatcctaaccaagactggcatagtacaatgagcctgtccctatcagcaggtttggaagccttaacaacaacaacaaaaacaataataatggtgatgataatcatagagcctaatgttaccaaacattttccatgtgttaagtactatactaagtgcatacttaatcctcacaacaatgctataagatagtagatactcttactactaccctgattttacaaatgtggaaactgaggcacagaagactaagagaacaggaatacacctaattcacctcagttcaacaaacatcaagcatctgttttatgtcaggcctcgtgctggatggcagggagagagagatgagtaaagcatagtttcagtccagtgggagcaaatgacagcacacagtggggcaggtatattgcagcccttctgcttgatgctaagaactcagtgtcagtgatgaatgaaacacagtcattctctcaaagatcttaaagcttagtaggagatatctgtgtggaaacaaaaattaaatactgctgtgataagtgtcataagagataagtggaaaatgagagagagagatcactgtagcaattgattggtttaaatcaaagcccccaaaaaaatgttattgagaattataaaacaactaattgatttaaatcaaagcccaaacagaagtgtttgctaattttatttcaatttggttgataatttggttgaaatgaatttatttcattttttattccatccttacaatggaagattagtgcttgtttcccacccaaggataccaggatatttcaggggctgtattacaatatagttaaattattcctttatctcaaagcacatccacactttcccctatccttacctttactcagggtatctcttctgcctcaggtgctttttctccacatttccatattcttaagtcctaccttccttcagggcctcactcaaatgcctcctcctccatgaagcattcacccgactgaaaggtaccccgccctctcctgtactccacatcacttcatgggtgtctccacttcctgctttatctttcagtaatacacttacagttctctttcctccactagactgagctcttcagaggaagactcacttggctgaaaccatgattttactttaaacacattgaaaacctctactggagtgcattgtgtctggtgggcttcaaccttaattcttaagtatgtgaaaacacatcacctatctggaggtttacactttctgctaatgactttatttttaagcccaccaccctaacacaacaaatacttaaaacttgtcttcatttcctttaggtctggccctcatgcatgcatataatttatagagtcactgttttgctcggttgtcctcatgcctctatattattggaggtttagattgtttccatatactcaggttgtattcatgtcctttttttctttttaaatttccttagcatccatttccaccattggaaattcagggtcaaaacaggggtttgggattggagcatgtctatcacagataaccaatcatgtgttatgacttaagaatttatgaaagggccctctacctgaagatatcttgctactgatgctgtctcacagtgtctgaaactcccatcatatgtggaattgttttggaaggctttgcctcctgggacacattcagccataatcaagaaatagtattgagcattagactgtcagtatgtccattagcaagactgtggaggaatggaatcaccaatattatattttataggggatacagaatacaagagaagttctgaagagaaaattcttatgtagaataggaaggcttagatacagcatgaaagctgcaggctttgaggagccagaggtcaaatgaaagcattgagtatttgtttagatgaaagaacagaaagggaaaaagaagcagaggaagggatagtagagagaaatgtataagttttatccatttaacttgtaattgtgtttggctatgggcacaatagaagcagtgagatcactttattttattttattctttatagacagggtcttgctatgttgcccaggctgcagtgtgcagctcttcacaagtgtgatcatagcgtactacaccctcaaactcctggactcaagcaatcctcccatctcagcctcctgagtagctgggactacaagtgcacaccaccacgcccagtgagatcacttgaaactagggagagatgtgtgagttctgggcaaccagtagttggctttacatagaactgtaggggtcaaggccaaaggggacgtcctgttccaagtcaccttctttggacattagaaaaccacgaggggtttggaaatcagaaaaccagcagaggcaggaaaactcagggcagcatgggagattcagtatatacaaaaaggttcacaccagtaatcaaacagaattttaactgctgatgtggagtagaggcagctttgtctgctgtgtgataaccaaacctttacgaatagtaggtgtatatggggaattggagggagataggtggctgtgtttagtaattggttgacttcactgagatggtttggggattgtggcttccagatgatcagattttcttttttaggtagagactccaacatcattacagaactataaattacatgtggaaaagaaaggcctcctatgttagaatagaaaataaaatgctgtggggttgagggacagaggtgctgtctaggaagtcagatagcgttttccagttctgtccctcagagttccttgtcctcattgagactcaatttctcttacttttttttttatactttaagttttagggtacatgtgcacaacatgcaggtttgttacatatgtatacatgtgccatgttggtgtgctgcacccattaactcatcatttaacattaggtatatctcctaatgctatccttcccctctcccctctccccaccacaggccctagtgtgtgatgttccccttcctgtgtccatgtgttctcattgttcaattctcacctgtgagtgagaacatgcggtgtttggttttttgtccttgtgatagtttgctgagaatgatggtttccagcttcatccatgtccctacaaaggacatgaactcttcattttttatggctgcgtagtattccatggtatatatgtgccacattttcttaatccagtttatcattgatggacatttgggttggttccaaggctttgctattgtgaatagtgccatgataaacatacgtgtgcatgtgtctttatagcagcatgatttataatccttagggtatatacccagtaatgggatggctgggtcaaatggtatttctagttctagatccctgaggaatcgccacactgacttccacaatggttcaactagtttacagtcccaccaacagtgtaaaagggttcctatttctccacgtcctctccagcacctgttgtttcctgactttttaatgatcaccattctaattggtgtgagatggtatctcgtggttttgatttgcatttctctgatggccagtgatgatgagcattttttcatgtgtctgttggctgtgtaaatgtcttctttgagacgtgtctgttcatatcctttgcccactttttgatagggttgtttgtttttttcttgtaaatttgtttgagttctttgtagattctggatattaccctttgtcagatgagtagattgcaaaagttttctcccattctgtaggttgcctgttcactctgatggtagtttcttttgctatgcagaagttctttagttgaattagatcccatttgtcaattttggcttttgttgccattgcttttggtgttttagacatgaagtccttgcccatgcctatgtcctgaatggtattgcgtaggttttcttctagggtttttatggttttaggtctaacatgtaagtctttaatccatcttgaattaattttagtataaggtgtaaggaagggatccagtttcagctgtctacatatggctagccagttttcccaacaccatttattaaatagggaatcctttccccatttcttgtttttgtcaggtttgtcaaagatcagatggttgtatatatgcggcattatttctcagggctctgttctgttccattggtctatatctctgttttggtaccagtaccatgctgttttggctactgtagccttgtagtatagtttgaagtcagatagcgtgatgcctccagctctgttcttttggcttagggttgacttggcgattcaggctcttttttggttccatatgaactttaaagtagttttttccatttctgtgaagaaagtcatgggtagcttgatgaggatggcattgaatctataaattaccttgggcagtatggccattttcacaatattgattcttcctacccatgagcatggaatgttcttccatttgtttgtatcttcttttatttcattgagcagtggtttgtagttctccttgaagaggtccttcaagtcccttgtaagttggattcctaggtattttattctcttagaagcaattgcaaatgggagttcactcatgatttggctctctgttttctgttattggtgcataagaatgcttgtgatttttgcacattgattttgtatcctgagactttgctgaagttgcttatcagcttaaggagattttgggttgagacgatggggttttctaggtatacaatcatgtcatctgcaaacagagacaatttgacttcctcttttcctaattgaatgccctttatttccttctcctgcctgattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaataactaatttattgagagtttttagcatgaagcgctgttgaattttgttaaaggccttttctgcatctattgagataatcatgtggtttttgtcgttggttctgtttatatgctggattatgtttattgatttgcgtatattgaaccagccttgcatcccagggatgaagcccacttgatcatagtggatacgctttttgctggtattttattgaggatttttgcatcaatgtttatcagggatatcggtctaaaattctcttttttgttgtgtctctgcctggctttggtatcaggatgatgttggcctcctaaaatgagttagggaggattccctctttttctatttattggaatagtttcagaaggaagggtaccagctcctccttgtacctctggtaggattcagctgtgaatccatctggttctggactttttttgattggtaagctattagttatatcctcaatttcagagcctgttattggtctattcagagattcaacttcttcctggtttagtcttgggatggtgtatgtgtcgaggaatttatccatttcttctagattttctagtttatttgcatacaggtgtttatagtatgctctgatggtagtttgtacttctgtgggatcggtgattatatcccctttatcattttttattgcgtctatttgattcttctcccttttcttctttattagtcttgctagtggtctatcaattttgttgatcttttcaaaaaaccagttcctggattcattgattttttgaagggttttttacatctctatttccttcagttctgctctgatcttagttatttcttgccttctgctagcttttgaatgtgtttgcccttgcttctctagttcttttaattgtgatgttagggtttcaattttggatctttcctgctttctcttgtgggcatttagtgctataaatttccctctccacactgctttgaatgtgtcccagagattctggtatgttgtgtctttgttctcattggtttcaaagaacatctttatttctgccttcatttcattatgtacctagtagtcattaaggagtaggttgttcagtttccatgtagttgagcggttttgagtgagtttcttaatcctgagttctagtttgattgcactgtagtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctgttaggtctgcttgacagtggagtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccattatgtaatggccttctttgtctcttttgatctttgttggtttaaagtctgttttatctgagactaggattgcaatccctgcctttttgtgttttccgtttgcttgataaatcttcttccatccctttattttgagcctatgtgtgtctctgcatgttagacgggtttcctgaatacagcacactgatgggtcttgtctctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgacggtctttacaatttggtatgtttttgcagtggctggtaccggttgttcctttccatgtttagtgcttccttcaggagctcctgcagtgcaggcctggtggtgacaaaatttctcagcatttgcttgtctgtaaaggattttatttctccttcacctatgaaggttagtttggctggatatgaaattctggttttaaaattcttttctttaagaatgttgaatattggcccccactctcttctggcttgtagagtttctgctgagagatcagctcttaatctgatgggcttccctttgtggggaacctgacctgtttctctggctgcctttaacattttttccttcatttcaactttggtgaatctgacaattatgtgtcttggagttgctcttctcaaggagtatctttgtggtgttctctgtatttcctgaatttgaatattggcctgccttgctagattggggaagttgtcctggataatatcctacagagtgttttccaacttggttccattctccccatcactttcaggtacaccaatcagacatagatttggtcttttcacatagtcccatatttcttggaggctttgttcatttctttttattctttttcctctgaacttctcgcttcatttcattcatttgatcttcaatcactgataccctttcttccagttgatctaatcggctactgaggcttgtgcatttgtcacgtagttctcgtgctgtgtttttcagctccatcaggtcctttaaggacttctctgcattggttattctagttagccatttgtctaattttttttcaaggtttttaacttctttgccatgcgttcgaacttcctcctttagctcagagtagtttgattgtctgaagccttcttctctcaactcgtcaaagtcattctccatccagctttgttccattgctggtgaggagctgcattcctttggaggaagaaaggcactctgatttttagagtttccggtttttctgctctgttttttccccatctttgtggttttatctccctttggtctttgaagatggtgatgtacagatgagcgtttggtgtggatgtcctttctgtttgttagttttccttctgtcaggaccctcagctgcaggtctgttggagtttgctgcaggtccactccagaccctgtttgcctggttatcagcagcagaggctgcagaacagtggatattggtgaacagaaaatgttgctggttgatcattcctctggaagttttgtctcagaggaatacccggatgtgtgaggtgtcagtctgcccctacttgggggtgcctcccagttaggctactcggggttcagggaaccacttgaggaggcagtctgtccgttctcagatctccagctgcatactgggagaaccactactctcttcaaagctgtcagacagggacatttaagtctgcagaggtttctgctgccttttgttcggctatgccctgcccccagaggtggagtctacagaggcaggcaggcctccttgagctgtggtgggctccacccagttcgagcttcccagctgctttgtttacctactcaagcttcagcaatggcgggcacccctcccccagcctcgctgctgccttgcagtttggtctcagactgctatactagcaatgagcgaggctctgtgggcgtaggaccctctgagccaggcacaggatataatctcctggtgtgccgtttgtgaagaccattgaaaaagtgcagtattatggtgggagtgacccgattttccaggtgccatctgtcacccctttctttgactaggaaagggaattctctgatcccttgtgcttcctgggtgaggcgatgtctcgccctgctttggctcatgctcggtgcgctgcacccactgtcctgcacccaccatttgacactcccctgtgagatgaacccggtacctcagttggaaatgcagaaatcacccatcttctgtgttgctcacgctgggagctgtagactggagctgttcctattcggccatcttcacaaaaatcttactttggtttctagtgttaccacccactgttctttctcatctcaaccctgagtataagtacagatcacattccttgggttcttagaaaataatagaaatgaactctcattcatcaaaatgcccattagtaaatactgagggagaacaaactagaaatccagtatagaaaataaaaataggattatattccttggaatctcagaaaaaaacaatgaagagctttctttgggcattagacactttcccataaggtggctgactctcttttagtcatgtcagcttggcccaatcttcacttggtagcccttctttcttcttcattaatccatctcctatgctcctatggggtcctagagaaatgcccatcatgtacacacacatctaataacacaaagatcactctcgactagcaagcccttttatgatggtgtgagcatttgacacccttgttgctagtaacatcagtgagtgacctgacccatttttggaacagaatatgatcagtatgttgcctcaaggaggccctcactgttctaggaaatataattccagagtttgctgactcacaccatggaatatatgcataaaatggatcctgcagataagcctttctctgactagtttcagacatttttttctgggtaattttaaagttattttttatttttgtgggtacaaagtaggtgtatatatgtatgaggtacctgaggcattttgatacaagcatacagtgtataataatcaccagagttaatggggtatccctcaccacaagcatttatcctttctttgtgatacaaacaatccaattatattcttttagttattttaagatgtataataaattattgttgactgcagtcaccctgttgagctatcaaatactagatcttattcattctaactatacttttgtacccagtagccatcccacttcctcccctcccactacccttcccagcctctgataaccatcattccactctctatctctatgagctcaattgttttaagttttagctcccacaaatatgtgagaaaatgccaagtttgtctttctgtgcctggcttatttcacataatataatgtcctctagttccatccatgttattgcaaatgacaggatctctttcttttttatggcttaatagtactttattgtatgtatgtaccacattttcttcatccatttgtctgttgatagacaagagttgcttccaaatattgactattgtgaatagtgctgcaataaacgtgggaatgcagatctctttgatatactgattttctttctttagggtgtatacccagcagtgggattgctgggtcatatgatagctctatttttagtattttgtggaacctcaaatctattctacataatggttttactgacttacatatccaccaacagtgtatgaggatactcttttctccacatcctcaccagcattcattactgcctgttctttggatgaaagccattttaactgtggtgaaatgagatctcattgttgttttgatgtgcacttctctgatgatcagtgaggttgaggaccttgtcatatatctgtttgtcatttgtatgttttattttgagagatgtctacccagatcttttgcccattttttaatcagattgttagattttttttttcctacagagtgcttgagctctttatatgccctagttactagtccctggtcagatgggtagtttgcaaatagttgctctcattctgtgggttgtctcttcactttgttgatcgaatcacttgctgtgcagaaggtttttaacttgatgtgacctcatttgtccatttttagttgcctgtgctggtgcggtattactcaagaaatttttgcccagattaatgttctggagagtttccccaatgttttcttgaagtagtttcatggattgatgtcttagatttaagtctttaatatgttttgattttatttttgtatttgctgagagatagggctctagtttccttctgcatatggatatccagtttttctagcaccttttgttaaagagactattcattctctaatatacgttcttggcacctttgttgaaaataagttcactgtagatgtatggacttgtttctgggttctctgttctgttccattggtctatgtgtctgcttttatgtgaataccatgttgttttggttgcaaaagctctgtagtataatttgaaatcaggtaatgtgattcttccagttttgctctgttctttttcctcaagatagctttgcctatcctgggtctcttgtggttctatataaattttaggattattttttctatttatgtcaagaatgtcattgatattttgatataaattgcgttgaatctgtagatagcttcaggtagtgtggacattttaacaatatcaattcttgaaatccacgaacatggaatatccttctattatttggatgtcttcttcaatttcttatattaatttttttttagttttcattgtagagatatttcatttatttgactaagtttattgctaggtattttattttatttttacctattgacaatgggattgctttcttgatttcttttttagattgttcactgttggcatacagaaatgctactgatttttatgtgatgattttgtatcccgcaactttactgaatttgtttatcagttctaataggcttttggtgcagactttaggcttttccaaatataagatcatattatctgcaaacaagaataatttgacttctttcttttcaatttggatgcctttcatttctttctcttgtctgattgctctaactaggacttccagtactctgttgaataacagtggggaaagttaacatccttgttttgtttcagatcttatagccaaggccttcagtttttctgaatttagtatgatactagctatgggtctgtcatatatggcttttattatgttgaagtatgttccctagttttttgaaggtttttatattttaaggaagataaaaattgaactttatcaaatgcttttcatgcaacaattgaaatgatcaagtgctttttgtctttcattctgttgatacgatgtatcacactgattgacttgtgtatttagaaccatccttgcatcccgtggtaaatcccacttagtcatggtgaatgaactttttaatgtgttgttgaattcagtttgctagtattttgttggggatttttgcatcagtgtttatcagggatattggcctatagttttccttttttttatgtgtcttttgggttttgttatcagggtaatactggccttgtagaatgagtttggaatgattctctcctctattttttgaaatactttgaataggattgatgttacttctttaaatgtttggtaaaattctgcactgaagccattgggtcctgggctttttactgctggggagacttttcattacagcttcaatcttattacttgttattggtctgttcaggctttagatttttttcatgaatcaatcttcacaagttgtctgtttctcaaaatttatcaatttcttctaggttttccaatgtattgtcatccagttgctcataatgccctctaatgatgccttgaatttttgcagtaaccactgtaatgtttccttttttaatctctgattttatttgagctttctctttttttcttagtctagctaaatatttgtcaatgttgtttgttcatccacaaaaccaacttttcatttcactgatcttttgtattattttttccttttaattttatttatttctattctgatatttatcatttcatttcttccagttatttgagtttggtttgctcttgcttttccagttctttaagatgcattgttaggttatttatttgaacttttttgatataggtgcatattgctataaactttcaccataatattgcttttgctgtatcccataggttttagtatgttgtttagtatgtttccaatttggtacatttcaataaatttttaaattttcttctttatttattgacatagtcattccagagtatactgtttaatttccatgtggtttgtatagtttccaaaattcctcttgttattgatttctagttttattccattgtggtcagagaagaagcttgatatgaatgcaattgttaataatttttttaaaacttgttttgtgacctaagatatgatctgtcattgagaatgatccatatgctgaggaaagaatgtatattctgcagccattggataaaattgtctttaaatatctattaggtccatttaagacataatgcagattaaagccgatgtttcattgttcatttttctgtctggatgatctcttcagtgctgaaagtggtgtgttaaaatctctaaatattattgttttgggatctttctcttctttcaactctgataatatttgctttagatacctgggtgctccagtgttgggtgcatatatacttaaaattgttgtatcctcctgatgaattgacccctttatcattatataatgaccttctttttctctttgtgtagtgtttgtcttgaaatctattttgtcggatattagtattgctgctaatttttttggtttccatttgcatgaaatatctttttcattcctttattttcaggcagcgtgtttctttatatttaataggtgaaatatgtttcttgtaaataaaaattattattttaaaatatttttaaaataatactattttttaataagaacaattattattttttaaaaaatttcattagttttgggggcacaagtggattttggttaaatgggtgagttctttagtagtggattttgagattttagtgcagcagccacctgagaagtgtacattacccatatattatatatatactatatatgctttatatatatagtgtgtatatataatatatatacaactacatattgggtaatgtacacttctcaggtgactgctgcactaaaatctcaaaatccactactaaagaactcacccatttaaccaaaatccacttgtgcccccaaaactaatgaaattttttaaaaaataataattgttcttattaaaaaatagtattattttaaaaatattttaaaataataatttttatttacaagaaacataattcacctattaaatataaagaaacacgctgcctgaaagtaaaggaatgaaaaagatatttcatgcaaatggaaaccaaaaaaattagcagctatactaatatattatatatatactacataaagcatatatatagtatagtatatatataatacatttataaagcatatatatagtatgtagataatatatgtttatatactttaagttctgggatacatgtgcagaacgtgcaggtttcttacataggtatactcgtgccatggtggtttgctgcacccatcaacctgccatatacattaagtatttctcctaatgctatctttcccctagccctaccccactccctgacaggccctggtgtatgatgttcccctccctgtgtccatgtgttctcattgttcaactgccacttatgagtgagaacatgtggtgtttggttttctgttcttgtgttttagtttgctgaggatgatggtttccagcttcatccatgtccctgcaaaggacatgaactcatcctttttgatggctgcatagtattccatggtgtatatgtgccacgttttctttatccagtatatcattgatgggcattttggttggttccaagtctttgctattgtgaatagtgctgcaataaacatacgtgtgcatttgtctttatagaagaatgatttataatcttttgggtatatacccagtaatgggattgctgagtcaaatgatatttctggttctagatccttaatgaattgccacactgtcttccacaatggttgaactaatttatgctcccaccaacagtgtaaaagcgttcctatttcttcaaatcctcaccagcatctgttgtttcctgactttttaatcgccattctaactggcatgagatggtatctcattgtggttttgatttgcatttctctaatgaccagtgatgatgagctttttttcatgtttgttggcagcataaatgtcttcttttgagaagtgtctgttcatattcttcacccactttttgatggagttatttgttttcttcttgtaaatttgtttaagttccttgtcgattctggatattagctctttgtcagatgaatagattgcaaaaattttctcccattctgtaagttgcctgttccctctgctgatagtttcttctgctgtgcagaagctctttagtttaattagatcccatttgtcaattttggcttttgttgccattgcttctggtgttttagtcatgaagtctctacccatgcctatgtcctggatggtattgccttggttttcttctacagtttttatggttttaggtcttgcatttaagtctttaatccatcttgagttaattttgtataacgtgtaaggaagaggtccactttcagttttctgcatgaggctaacgagttttcccaacaccatttattaaatagggaatcctttccccattgtttgtttttgtcaagtttgtcaaagatcaggtggttgtagatgtgtggtgttatttctgaggcctctgctctgttccacgtgtctatatctctgttttggtaccagtaccatgctgttttgggtactgtaccacttgattggtgagagagggaatccttgtcttgcactggttttcaaagggaatgcttcagcttttgcctattcagtatgaccaatatgtagtcttttattcctcaccctctctcaacaccccacccccacggagtcctcaaagtccattatatcactctgtatgtttttgcgttctcatagcttagctcccacttataaatgagaaaatacagtatttggttttccattctttggttacttaattagtataatggcctccagctccatccaggtgtcttgtttttcatccattcagccagtctataacttttgcttggagagtttcgtccatttagattcagcgttatgattgataactaagggcttactcctgccatttggttgttttctggttattctgtggtcttctcttccttttttccttctttcctgtctcccttttagtgaaagtggttttctctggtggtgtattttattttcttcctttttatttttttttgtgtgtatttgttgcatgttattgatttgaggttaccatgaggcttgtacataatattttctaactcattatttcaaactgatgacaacactctatcgcataaaaaaacatggaaagagaaaactaataaaaactctacattttaacttcatctctctgcttgttgtcactttgtcgtttctatttacatcttattgtactgtttatgtcttgaaaagtagtttcagttattacttttgattggttcatctcatagtctttctactcaagatatgagtagttcacacaccacaattacagtgttacaatattctgtgtttttctgtgtactttcaattacccatgagttttgtattttcagataatttgttattgctcactaacatcctattctttcagattaaagagctccctttagcatttcttgtaggaaaagtctggtgttaatgaattccttcagctcttgttgatctgtgaaagtctttatttttccttcatgtttcaaggatattttcactggatagtctattctagggtaaaagttttttttttttttttcttcagcccttcaggtaagtcatgccactctctcctggcctataaggctaccactgaaaagtctgctgccagacatatatgagttccattctatgttacttgtttattttctcttgttacttttaggatcctttctttatctttgacctttgggagtttgattattaaatgccttgaggtggtcttttttggattaaatcttcttcgtgttcttgtacttggatattaatatctttctctaggtttgggaagttctctgttattatccctttgaataaactttctaccaagatctctctttctctctctgtctctctctctctctctctctccttcttaaggccaataacttttagatttgcccttttgaggctgttttctagatctcgtaggtgtgcttcattgtttgctattttttttttttttttgtctcttctgactacattttcaaatagcctgttttaaaactcactaattctttcttttgcctggtcaattatgctgttaagagactctgaggcattcttcagtgtgtcagttgcatttttcagcaccagaatgtctgcttatttttttttagattatttccatctctttgttaaatatatctgatagaattctgaattctttcttagtgttatctttaatttccttgaatttcctcaacacaactattttgaattatctgtctgaaaggtcacatatctctatttttccaggattgctatctggtgctttatttagttcattttgtgaggtcatgttttcctggatggtgttaatgctagtagatgtttttcagtgtctgagcattgaaaagttagatgtttattgtagtcttcacagtctgggcttgttcatacctgccctccttgggagactttccaagtattcgaagggatttggatgctgtgatcttagtctttggtcactgcagccatatctgctttatggagcatcccatgctcagtaatgctgtggctctttcagactcatagagttactgcctgcatgctcttgggtaagagccaggaaaattccctggattaccaagcagagactcttgttctcttctctcactttcccccaaacaaatagagtctctctctctctctctctttctctctctctctctccctctcattctctgccgacctgcctgaatctggggtagggatgacacaatcacatttgtagtcaacaccattgggactgtgctaggtcagacccaaagctggcacagcactgagtctcgcccaacgcccacagagaccactccctgggtaatgtctgtgtttgctcaaagcctaagggctatacaatcagtcagtggtgaagccagcctgtcttatgtccttcccttcagggtgatgagttcctcaagcaggtccagggatggtgtccaggagccaaggcctcgagctgtgactgagctggcacccaatccataagacaaagattttttccacactttccttccttgtcctcaagcaaaggagtctctccctgtggccaccaccacccccatgttcatggcaagtattgtctggctaccaccaatcttcactcaaggcccaggggttctttagttagcttatggtgaatgctaccaaggctgagtctctcccttcaaggaagtgggctcctctctggcccagggcaggtccggaaatactatccaagagccaaggcctggaatcagtttccccaagagtccatttggtgctctacacccactgtggcagaaccagtacccaagctgcaagacaaagtcctctttactcttccttctcctttacagagactctccctatagccaccacagctgggaatatgctgggtcactcttgaagcaagaacagctctgagtctcactcaaaactcctggcaagtactgcctggctatcacactgattattcagggcccaagggctctttagtcagcaggagatgaatcctgccagtactgattccttcccttcaaggcagccggtttctttctggcccagtgtgtatctagaaatatcatttgggagctagggcctggcatggtgacctcaggactctgcctggtgccctgttctactgtggctgatgtagtatccaaattgcaagaccaagtcctctttactctcccctctcctgtcttcaagcagaaggaatgagtccgccctggagttgggagctgcattgcctgggattggaggaggggtggcacaagcactctcttggtcaccccagctggtgtcttactaggtcgcatgttccccaagtccactggctctgaggctagcacaccaggatttgaccaagaattgcaattcttgtggcttacactgcctttcaagtttatttgagatcccagagcactttagcccacagtgacagggcttgccagaatttagtttctgactgctgagatggacaatttgcgtctgattagggctggtctaagtgctccttctgtgggcactggctgagttctgctccatgttgctttctgctgtgacagggcaacattgagtttcaatgcaagtcccacagtcactgcaatcttcctctcccaagcctgctctgaacaccatgtggttgctgctgggggctgggggagggatgttgtaggcaattcaagaatgtctttcctacccttttcggtgcttctttccttggtatgatattaaaaccagttactgtgattgctcacctgatttttggttcttatgaaggtgcttttttgtgtggatcactgttcaatttgtgcctgcaagcggggatgggggacaattgctggaggcttctctttggccatcttgctccacctctaccctagtattagcaatttcaaagcagttgggatggaggtagaaggaaagggcgcttggaatcagaaaatccatgtcttagctttgagccttagaaaattcatttgacccttgtaagcctcagttgcttcatctgtaaaagagaaataatataatggctgaaaagatcaaaggtgataatgcttttgaaaacactatagaaaatgacaaaatatcacatgagtattattttctagtttctaggagtctccttaccattgtacaggacaaccatgtctatttttaaataaattattatttgcctctgagcaaccctgcaaagagttgcctgtaggagaaacagctttacttgcaaatcactccactgttttctttgtgcacagcttattaatacataaggcacatgtcctccagcctgcagtaacattggaatcattacctctttggagtacctaccagagcttctcaaagtgaattttgtttatcaccacaaaaaatagtctgttgcagagataacctccaaattcaatgacaatatttccaatcacttttgcatgatgcagaaatagacaaatatataattttgcttatagagacaattattgtctcccaacaagtgatcagtagtcagaaaatggccaagaaataccatggggtgtgccttcccataacagcttatctttgtgttttagttgcaaggttactaaaagcctgtgcagggtttatggcaaaagtaaaacttgctccaggagcaagcccttgtttcattgtctaatgttcttaatccccagcagacaggatttggatctggcatttggtaacagggcagtttccaaagttgctgtacgcaacttgaggaagagaggtgatattatcggaatgaatttctttgttgtaagttataaatgtatgggcttttccaatcccatcacccttaaaactttatttgttttctgcagtgagggtgtctccgttgtctttaatatgcttgctttgagttcatggatgaacattcctgcctggctgacatgtggactctctgaaattgttataaggtctttttctttgtttttttcttgatgcccaagctgccaagggtagtactggcagtggtgggcagacaaggaggtgatagcaaactttgtcctctggcctcccttgacccattccattcattatctaagggactccaagccagcattccacagagtgccctcaccaaactcactaagactgaaggcgaaccaggattccaaacagccattatgaaaggaaagagagagagacttagggtttgcaaaataagataccctgttgattctttttattccatacagatactactattctttaggaaaacgttaaaatcacatgatcttccaggacctgggctgcttctttaagaagcatgttacagaaagctttattggccaacaacatattgaaagatagattaatcaatcattcattcaaataaggtatattcagaattgaggtatattgtagccagacagtgagactacaaaaaaagaatgcaccgtacccttatctcttgcacaatctaacgagggagataaccactctttcaatttatagtgacctataacatttcgtacactgctgaatatctttacatggtaataacacaatggaaagcttgcaaaatagacagaggctaggggaagaaggattgagtgtgaatatagcctcttataaatcgagaggaatggtctgtgtcttctgatcatacagagataataaatatggaaatgatttcaaactaacaaagcaaatgtgcagaaaatactgagaatatagtgggcaggatacctgagttttggttccatctctgttattgactcattgtgtaatctgagtcaggtctgttctgctctctggatctcaccctttcctatctgtaaaatgagattgttggattagatgatctccatagaggttctcacctattctgacattcaaaaggactcctaatttttcttatataataataatatatatgatctgtagagtgctttacactttatatgatatttttgcatctgttatctcatgtgagaaaagcactggactgctggactggcaatgaggacacctggattcttgtctctgttttgacactgattcatggtgtgatcttcaagcaaattctctgagtttcagtttctcaatctgtaaaataggggggtatgaagattggactaaatcagtaggtctctaaaatgttccacaaagccctggggtggggggctcctacagagtttcgctaaggcaaaccacaacgctaagcctgcatggaagaggagaaaaagagtggcctgacaagagaagttcccagtttcctatgccaaccccaggcagattacatttaattttatctgatttatatagagagtttctatgtaatgttttattcttaaaaatagtttactataaaaaactcaactggtttgatttttaaagattgcacatataagtgagatcatgcagtcagtatttgtctttctatgcctggcttatttcacttagcataatgtcttccagcatcatctatgttgctgcaaatgacagacttttcttttcattaaaggctatatagtattccatcgtgtatgtacaccacattttctcttttgtaactttcattttaggttcaggggttcatgtgcatgtttgatatataggtaaactgcatgtcagagaggtttcttgtacagattatttcatcacccaggtaataagcatagtatctaatcaatttttttctgatcctctcccttctcccaccctacaacctcaagtaggccctggtgtctattgttcccctctttgtgtccattacaccacattttctttatccacttatccatccatggacacttagtttgcttccatatgttggctattgtgaataatgctgaaaaaagtcaaactcatagaagcagagagtagaatggtggttaccagggactgggaggcagttgactgagctaggaaaagagagataataaaagggtacaatgtgtcagttatatagaaggaataagttatattgaactattgcacagcatggtgaccatagttaataataatgtattatatgtctcagtattgctaaaagagtaaatttaaatattctaaccacaaaaaattattagtaggcaaggtgatggatatgttaatttgcttgatttaatctttctagaatgcatacatatatcaaaacatcccactgtaccccataaatatatacaattattatttgtcaatttagaaatttaaaaacttgatttagatgagctctaaggccttaagtattaaagtattaagtattaaagtgatatgtaaccaagtatattgtttggtaacttcatttttgttattattttaacaaaccaatatattgtgaatatacttccaagtgaaaagaaaaaagacattgcagtcatcactaataactgcaaaacattcctttgcaagaatatggaataattcatttaatcattcccctaatgttagacattcaaatgtttccaactttttctatttaaataatgctacaataaacttctattttgtgcttattgtattattttcttacaacacatccctagaagtggaattcctagaagtttatacacatttccaatttttttccaaatatatggcaaaatttctctctaaagtatttttattcctaccagaaatacctcttcaccaacacgtagtatttaatctgtaccaatctggcttaagacaatgatatttaatttgtatttctgtgatttctagctaaattaaataatcttcatatgcttattggtcatttgtacttctaactgctttctcctgtctgttgcccatttttctattgtgctgtttatttttatatatcgaatatattgaccattggttttacatacttgatgctaataattattcttagtttatggtttgtctttgagttttataatggtgtttatttcacataagaaattataaatgttttctaatgaaatttatcaagtctgtcttcacttatgttttcttcattgtcaataacttaaaatgaccttttctacctttaaaaattttgaaattttcctctgtattgtctaatagtacttacatgatttcctcttttaaattgacatatttaatccatttggaatttattttgattttaactagtaatttaactttattttcttctccaaatgattcactagttgttctgacattatttagtgaataattcatcctttcttcactgaattggaatggcatattccatatactgtgtctggttttggcttttctgatctcttccactgatcaacctaagctggagccagtatcaaactgttgtaatcattatgcctttagatactttaaatgtacagcagggaatgtcttattactcttatttttcacaaatatcttggcattgtctcatgttttattccttcagataaattttgggattattttgtcaagattttgtttgagttgttttaaatttttagatttcattgggaaagaactgaaatccttgaaatattgcttcttcttagccaggaatatggtacaactttgcatttaattcagttctttccttaaataccaccatgaagttttttgttttgttcatataggtcctgcattaacaccatatatataaagtgtgagaaatactacattcttcaggattctctgtaggttaacaatgaagatgatgactcaaccctttctttgtttgcataatgtgatgccactaatagtgggtaacttctctgccttacctcctctgttccaaacaggatttttcagaatgaacaaattaaaagaatcataatcagacactaaccccaagccatactgcatggcagcaccaatgggactgacagaaaacaacagaaataggaagaaatcctacagagaaacaaacttgaaagctgtctcatggcctttgaatcatacttaagttttatgatggaaggatacgactatgaagaaagacacagagcaacatcagacagtcaagaatttcagagccagctggcatgcagtggacctcatgccagcccattttatgactatttaggtagtcaagggtttaagatttttctaataagacagttattatgcatttcaatgagtgatttctttgcagctctagagtgtggccttacctacttcaacatgagaagatttttgtattttgtcagtcatttcacaatgacttttagtgagcccttcattatagactgtggatacaactttgctgttggaaattaacagtgtcaaacaactgggtataatgtttgtaatatctgaggagggggagctgcctaggaagttgtattccctgtgttaatttttcagtctcttaggttatagaggaccttctagaaccaccttacagcaggattacatcccatttacacagttctctgtcacttgaatacagagaagggatccacaaggccatatgcttcctagacaaagagaaaagatttctgccacactcagaacgctttgtcttcagactataatcacccacaccatatttcctttggatccactttccagatttttgtgctggcactaacaccaacttgctgtggcttggggcatgtaatttcaatactttgtgcccattttcataagtgaagtgtcaggcatcacattggacattttaagattctttacagcccaatgattctgtgtttctaattaggcccaatgggttagagctaaaaggaaacagtgagtttcctggaaggaaaggacatataacacagtccagaggtaaaatgggctgtattcaagaaaagataggacaatactttgcagggatgctgcagagaggattcaagccttgtatggaggaatggatgtgatacaaccaaaaagtctttaaaaattctttccaactaatctgagatttgtaaccttatggactgtgatttgcagcaaaccaaggatgtgataaagactagtattgtttctagaatgcaaggatggttcaacatatgcaaatcaatagtattaacagaatgaaggacaaaaactatatgatcatctcaatagatgcagaaaaataatttgacaaaattcaacatcattttatgataaaatctttcaagaaattgggtattagaaggaatgtttctcaacacaataaaggccatatcagacaagcccacagctaacattatattcaatgaccaggaatgagataaggatgctcactctcaccacttctgtttaacatagtactggaagtcctagccaatttcatattaatgagcctcattttcttcatcatagaatgaagtatataataatccctgttatacttactttgcacagattattattattatttaattattattttgagacagggtctcactctgtcacccaggctggagtgcagtaccacaatcacagcttacttcagccacgacctcccaggcataaaggatcctagcccctcagcctcctgagtagctgggagtacaggtgcacaccaccacacctagctaatttttttttttcatttttttatagagacggagtctcactatgctgcccaggctggtctcaaactcctgtgctcaagcaatctttccaccttggccttccaaagtgctgggattacaggagtgagccactgcacctggccttgcagattattattaaactttgtaaactaatcaaatgagagtgattattgttactgttaagaactctgatagcctcatccatatatttggagaaattgaataaataataggaaagaaataatagcatcccaatgattttaccttggctctaccatcatttggggaagtgataattcagataggagaagtgacttggaagcagtcttgagagattgcctgttccatcccctatctttgtccttaaaccaaattgtacagataaataaggtcttatttttaggacttacagaaaaaagattcctttcatatccatctttgcaatcctcaaccacttctgtcactattatgtgtcatttcaaacattaaattcctcattctgctttgaaggaacacatgtgtcatgtgtacccatttgtatgttttggtgtgttttatgctttatgtgatcacccacatatgcacagataattccaaaatccagtgtgtgggtgttgtattccctgtgttaattattcagtcacactcaaacacctatgcactcacacatacatgaatacacacatgtacattagcatgtttatgcttatgttgcatgtgactggcaacatcagtgcctttctaaggcaatgttaactaccttgagttttgggagagctttagagaacaaagacaagagactaaatgattctagatgtaagagacaatgttgcaataagttactatcctaaaaagacagaatacagggacaagagactattattttggatagtttcttgcttaccagtaatacttaagtcctttacattaaaaaaaaaaaactctgtaaatatattgcagaagaaatccagacatccttcaagattcttagagctggaaaagattttaatgactttccagtccaatctatctcatgtaatcaatggggcccagagaggcaaaaggtcttgtccaaggtcatatagtgagttagtgataaggctgaacaaggattcagatgttggggcttccagcccactgctctttctctcatctgggatttgtgtatttttgttcattagagattttcctctgtaacctcaatatccaatgcagggccttgcacataatagattatcagtaaatgttaaattaatatgtcatggctttggttgtactgggcttttgcacttactcctgagtaaattgtaaagaatatctacgttttaggttgccttgttttagaccaagaggtacccagagaaaaggtgtgaactatgctaaggaaattatccgagttccaaattgaaaaaaaaaaaaaatcatgcttttccgctataacctctctcattcacagagtgattctctttcagaagggcaatctagaactattatgggagccatattccattggtggtgcaaccatttcttgacaaactagggtccaagaaagtattttcctggggaagatgagatttctcaaagaaggcacgcactttctaacctaagcttatttcagtaatcaatgtaacaagctggtcttgatgattgcagcagtaccaatactgtgggagtgtaccagttctagaacagctacaacattggaattgaacgcactagaattggatacaggacctgtttttgaggagctaacacccaaaggctgaacagcactcgtagcaccgtcctttctgtgcacatatggtagtcctcagtttgcaacagaaataaagctgttagcaaattatgtgttctatttatgcaaataaaatcttgtggtatgctagaaagagcactggcctggagaccttagttttctcatatgttaaaaacccctaacacaggcctggttcatagtaggcacccaataaatagtagttttcttcctttgggggcctccgattcagtgtgcttcttcaggtaagtcacttccctggaactcctccttggaatgagagttgtactgttgtgatttttaacagttccttcaagccaagcattttggaatcctttcataaagggagaaaggaaggaaagaagaaaggaaaattaaaggaaaaagaacaaataaaacgttaaaaaggaggaaaggaaaaaggatcctttactacaataaaactaatcttatgttcttgcaagtagcactttaagtaaaagaagttctttgctgacctggttactactgaacctactacataaaatagcctactataatagatgcatttatgtgcctaatcttcactttttaggcttagtaaagggagaggaaagctgatgtatagttaaatttatgtttttagttgtttttttttctactctcaaatatcaatcactctttagtttctctttctttttccgaccacaagcattcttcctctgcttaaagaagcttccctaaaatcccagtctatccagtaagccaaagcacagcaataaatttgaggaaaaaataccagggacttagagacagaaaggagtgaggggatgcagaagctgaagctggagcacggttgcaagcatgagaagttctgcgtgtttcagagcagccaaggatgtatttttgcctattcctgctggtgactctgtgtgtctatgcatccatctgctatatttacatgtttagtcagtcaatccacgtttgctgagagcctgctgtgtgccaggattgtgctagcgtaaaggagcaaagtattgagcaaaatatgtttgagcagctgtaattctgaggatctctaggtctgagcatgtgtatgtgtgtgcgcttctatgtatctgtgacaactccaggtgttcatgacagtgatctttgttactctgttggcttcatcgaacttccttttacttgctgtgattcactacatagagtgggctttatctctgatttttataacctgcaagactgggggtatgatcaccagcaatctaaaaacagttagaaatcccatggagttatcttttgtagaaattttcctctactaatattatgaaaaataagcatcttattagctcgagtgtaattctatgcatgattacaggtatcaataggaagaaacattgactgagttcaaatctcttctacgccatgctaaaggggtgacaagttccacaatggatcattttctcatgggcatttctgacttttggtaaaagtagagcaccttattttaaaaaccattgagtagtcctaatagtggagatatcatcaggatctgaattgttcatccctaaaaaaaacaccaatggaaatcaaacaatatagtgccaaattaaactgtttgaatatttaggttctgtatgatcaaattgtttggtgccatactctgtccacttttttcatgtggtaggatataatttcatatcttttctgttctagaaatacccgaagaaagagactctggaaactcattatcaggtctatcaactcttgtatttgttctcccagggaaacagaagtacctgtgcgccagcagaaatgattgcactattgataaattccgaaggaaaaattgtccatcttgtcgtcttcggaaatgttatgaagcagggatgactctgggaggtaagatacttttctttctcttcctcctccttcctctctcccccttctccctcattttctagtctctctttagaccagattttcttctttgatgcttccaaggggaccagccatgctctagacacaggctgaccctttcataggcaacgtggccatcagccagctggtgccttttttttaatccttatctataccaatccccattccggggctcagcattagagcaggcggtgtgaagcagggatcaggagccaacagaaggtgagtgaggatgcatctgactgggcagggcccccaggggacttaatgatactggcctgatgttgttcagtggtagctaggatgagagaactaagaaatccagaacagtcagaggtgcaggatgacccaggcataggcgcaggatgacccaggcacaggctgatcctgaacacctgggaatatcccttagctaactgctgcctatgttgtagggccagccacctcgaatgagaagctacttctctttggagcctgtgactaggctgccacacagagccaatttcctatcctatctctcccaaagatgagcaggtgttttaataatttccttttctttgcaaagctattgaccatttccaaaagcattttttttcagtagcacagtaacgtgatagatggaagatacagctctttcaagggcgttcctctatcataaggctctctgtcccacaaacctgtctaccatgagtgttgtcaccattccagaaaggcttgacatcagttgattgagacttatattttccctctccaaactcccccatctcttcatgtttacatctgcccaatgccagggtcctcgctgctgcctgctacttccaaaaagatgtgtctttcatgagaaaaacaagatcattaatccacttcgatttggaaatggaatttgaagaaaggcaagcctatttctgagtgcctgcaactgtagcctcatacccaattattcattattagcctggaaaacccaagtgcctagaatccaaccctctcccctctcctcttaagtctaatttagaccagttgtctatctctggctttctgtgaggtgttcaataccttgtctgcctatgtgcacatttatagacaacaactagttctcttatcctggagcagggccatgtgtggatcttcatatagataactatatcctccccatcctcacagggcagtagtattatttaaacagaacaaagtacctcacatgaattgacccaggctggatgagagacaatttcaaaagaatcatctcaagtagcgtccagtactcccaaacatcacaggtagatgttctgtgagtggctttccaagcatccacatcaaatgagactcagatatctgagaaaactcaaccttgttttggtttgcttggtgcaccccaaagaaatccaacaattgaggtctacagtggagaagaagtaggactggggtcagggagtacagaggcaaaggcaggaagggtgacaaagtgattgacaagaaaaaatgttctccatatgaatgttgcagccccatgttgagggttcttatacactcaactgtcaattatttagccttctgtgaattatgtatagtataaaagatagggactctcaagtagggaacctcttggcttgccatctggcaatatgaattgcaagtccactttgatgcaggtaaagtttaatggtaacaaaagtcctcataacatttggatgcaaatcttaacattaattccatgtctcagccaacattctccattattaagcagcctgtgatgtgattacagtgaaccacttttgaaaaggagcctgtgtataacagatagtttcactatactatataaccgtcagatgcaggcttgtaaattaatttgttggtgacaatgtttcagtacattttcaaattgattcattggtatagtactcaaatttgagtgggcttggtgaacacaatgaagacaagctgagaagtgctgtgactggccttcatttcagttgcaggcccatgatattttgagtgtcttccatgtacaaggcaccatgctaggcattagagcttgaggctggcaaacttcaggaagtgttcacaagataccaggattcttgatgttgtgtaaatggccttgcctttagagtcaggcagatctagtttaaaggctcagctcctttatttactgtgtgcccctctgagcctcaatttcctcatctctgatttagaaataccatcctcatagagttataatgagtatcagatgacatgatgaatgtgaacatccttgataaatagcaaaatgctagacaaatatgggggcttaatatgacattgaggtcactagtaatttagctggaaagtctgtaacacagcacttcccgatggcttttaccctaagtaacttggtatgccatataatatgtaacagcaccaacaggcagagaatcgccagaaaacactcttgattacctcaaacgaaaaagtaccaccaggatcctgttcagaagctaattttagtaattaagggaatcatatgctatgttcaaataccatgccagtaaaaacccaattgtttaccttcttaaatcactgcttgaagagcaaatctttccattttgctgaatgaacttatctccacgttccctgccctactgacacaaccccctcccaagtttattgttaacttacacattcaatgcacagcacacctttactcaaacaatggaaaagaaagaaagtgtcaattcaaagtggcccttgtctattccttaaggagtagacttccattttcatcagatttggatttagcatagacatattgattaccttgaagaagaattcatataattttatcttctgattcccatcactcaaatcaaaattacataatatattccaaaatggcaactaggaatgtggccttgggcaagtcccttctctcctctgatgcttggttttcccatcatagaactggaattgtggcttcaccgaggacctttctggtgctaacattttgtgattctatgtaaaaagccacacagaaaggattgtttttcagccctttcttagattgtctgttccctgctcccagaagtatagatagtgagacttgagtgctttgatacatcgtaattgtatctacctccattcacacctacttaagatatctgtctaaaagtagactagacagattattcagagagtggagggcagaagggctgtctctgtatcttaaagaagctggcactcttcagctgatggctgcttggtcttgaggcctcaagatctttaatctggctttctctatagtgtttcattcactgtttggtgatggaatctcttcagttcagagatacttaatagatatagctttttctttcctgcttccaggcctacctacctgtttcttgcttttttttctagcagctgttgttgtttctgaaagaatcttgagggtgtttggagtctcagaatggcttccttaaagactaccttcagactctcagctgctcatccacaacagagatcagcctttctttgtagatgattcattcctggctgcatttgaaaaccacatattgttaattgcttgacgaatttaaatcccttgactacttttcatttcagaaaacacttacaaaaaaagtccaaatgaggaccttccctccagtgaattagctgtggctttctcacagtccatagttaggataaatgtaaagccatttctcatttttctccgcactttccaagggtacactccttgtttccaagatggaatgagaaataaagaagtgcccttcctgccatcttctcccctgaccctttcctccttcccactttcctcctattcctccccaaacatgatttatttctgcgttttgcaactcttgagttctcagcatttagtaaatggtgttggtccctgttgattccttcctctcctggaccatggaaggtagtaggcctttcagaaatttcaggtagcagccaaaccccagaagaagagaaggaacacagagacctagaccatgtgagaacctgaggtgtgcagcatttacttcacagattcgtctagcatatttgagaggtgtctttcctactaggagactgaactctgcatctgagaataaaaacttaacatatctacaggttttgacaacctctgtgaattatctagttgagaggatggctcaaggagcctattgccatggtctgatgtcgttatggacgctatgaacatccttgcagtttccattgttgaagacagccctgatgccagctgtctcatcattccccatgttcaagagcatcccagcattgctacctcaggatcccatgtcctgaatgcaacagagtgatttcgctgctgaattactattcatggcatggctcttcacagcatttattcatccatgtatctatccattcatccttccagccagccaagaagttcacgctttcatcttttcatccatttactcacctatttattcatttagcaaatatttattgagtaccaactatgtgccagacactctgctaggcattttggggaagcagaactgaataagatactattcctttcctcaaaaatttgagcaagaggagaaaggaagtaatgaggaatattccttagccataaaggaaaaataagaaatcacttggaagaagttaggtgagatggaaggaaaaggacatctaaggtaaagcgtacagtttgaataaaggcacagagacatgaacaaaatgcattgagggtttgaggaacagcaattggtttaacatggccagagctggggaaatggtaagggcaagctgaaaccacattgaaagcaaacttggttattatactaggtagtttagacttcaagcagttgaaaatctttgagcatgggataggcatgatgacattgtgtttatttgcatgtttctttaaagaaaactggcagcagcacaaatgttttgttgatgagggtttaaattgtagaaagtgagacaattttaggaaggccagctagagagaaatttctagcatcaaattttgctaaacacctaggatttgtagttacctccatttgggttgttacctgcaagtactgaccacgtatatgaagaagtactggtttagaccaaggcaattggcttgtataagaggcctaccctcataccaaaagccagtttccttggtctaggccagtgtttactggtatgtgtcctgagaaaactagttccatgacatgttccatgaaaaatatgatttctattgtcaaataagtgagggaaacttgcatatcatggtcctgctcaggaagatttacaatccttattagcatatcacaggtcctggtgaatactgcggtaaagtaaccgaggagctttgtaactcaggattcccgaagttgattcaaccacaggacctcatttattcacataacacctgttatcctacaaaaccactgttctctggaatacactttcgaaaacatgggtatagacaaaaactctatcctataggcagagaatacctatacctctagctcaggtcatcattttgcagatgtgtgtgtcattaagaatcagtcaataatgcattaatgatcaaaagcagaccatccttaccacatggtgcataagattatgctattatgctattagctactaatgccactaaagttaattatgttgggtctgcaacgttgtcatacacaaaggataggatgcaaaactgtcctaggccaaagcatggttattgcccaagttatctaatgtctgcaggtacatattcctggcctaaggattgtgctaaagaagttatttctaagaaatatagtgacttccagcatcatgcagaatgaccatttaatattttgaatatctagacattctgctgtagaatttaatagtccttttatacactgtctgaccaacattttgacatttactcagaaccccatcacagtgctaccacataacctcattgctaaagtgggaggcctagaaatcacagatttgtagaaaccatccaatgattgaatcccctctacttcctgttcagcaggcagcagagtgtcataaagaattaacaacgtggaactcagttactgggatttcttccattctcctttgattctctagactagaattccaaagaccctcaggctggtgatgcaagtgggaagtctcatttctgagaagtgctgcttcctacccacaattctttgatagctgagtgctttagctgatctgcataactgaggtgtgcaccaaggagcagaattactctataaattttggcatcaacatgtgcaacttgtgactcagcactttgaaactctggggatttttttgtttggttggtttttgttttaagatgtcctgtggtatagtggaaatagtacaatagactcagatacagagaggccttgtttctagtcttggttctgtcacttactatcttgatgtccttgcacaaatcaccagacctctctgagcctcagtttctccaaccacactgtgggaataataaaatcttttttacggcattgttgtaagtatgtagagaaactggtacacagtaggcacacaatcaatgtcaccgtacccttcagcccttcttttgtggatgaaaaatggtctttgtgctcccagtcaccactggggtctgttctctctctctctgctgttacagtgtggcttttggttcttgtttctttgttctttggtctgtaaattacccttgaaacaacccttgaaatttccactccatgacctaaatcgtcatccctaaattggttacatacatatttggtgacactttggaggggaaaagctttatgtctctctaactgtagttcttaagggaatttgcatatggaaaaaacagagactgcgtctcttaattcctccaaaccaaattatctgggatagcacatatatgttgtactctgtctctgagcatttgctcttagagaactatggttagagcgaagtaaatttttctaatcataaaaattaatgataccgcatatctgatacttgaatgagtacctccttgtaaaatttatacttaaatccttgagtttttaaagtgtaatagcaatagaaagattttattgttgtttacttttactgtgagtgctccaaaatccctcagttgctcttgaaagagcaagatgatgccataggcaatattttccaaaggtagtaggcagaaaactgagtacacagcacacaataggccatatatacaaaagcaagtattttgcaaataataataattcaggaaaaaagcttcactttcgttggtaacctgtttgtttaaaaccattttattatttattatttaaaaagagtgtcacttgttacagattgtgggatgtgttccttaagatcacaaaaatgtaaaatattttctttttatactgaacacatgcatagacaacttacctgagcaagctgctttttggagacatttgcacatcttttgggatcacgttgttaagaagtagaactaagggaaaaacacgcagccacccagaaatcggtagagccttcagctcatctgttattaatatttctgtgacaacagatatctaggaagtaaacaggaaattgcatcgctatcctgcatcaccttttttggaatcaggttccattcttctcagtccagttcaaccttgtgatactttttagatctcaaccaaggcatagaaatatattttcccttgcttaataccccatggaaccaatgcccctgtggttgaagtaaaaattgattgttgagggacatttcagccctctagcagtcaacaattaaaaacatgtaagcaccgagcacctgcagaaaacttggactggcatttggatctaagaagaaaatctgcatcttgaccaagatgaaaagtcaccagcccaagcttgtgcagtgaagtgtcatgttggccacaatgaaactgaaagagactgatgactctcctcagggtggaaaatgaggcatggaagctttgattagtgagctgttaggcacacagacattaatttcaaagcattctcatctccagtctgagtaataatgcttatagtattatgcaattgtttggctgctgcaagaaattcagcagactccaacaagtagtctttcttggtctctgagtgactgtaacttaaattctacctcccttctcttctcctacatcttctcactccccaccccacccccacatacacacaattcttgtccactatgttcagagagatgcacgcacacatatatatgtatatatatagtatatttgtcaataaagcagaaaagaagaaaaaactccaagtaaacaattttccatttccccatctcacttctgtcttacaagtggataggaaaagaaaaacccccagtaaaaaatggcaaccgcccacctccccaactttacatgctgcttcctatgttagaggatctgtcttaggcatctgattatggagcctgctagatacaagcccgtatttagactgctacagtcaacaatgtctctctttcatactagaaaaattccgggttggcaattgcaagcatctcaaaatgaccagaccctgaagaaaggctgacttgcctcattcaaaatgagggctctagagggctctagtggatagtctggagaaacctggcgtctgaggcttaggagcttaggtttttgctcctcaacacagactttgacgttggggttgggggctactctcttgattgctgactccctccagcgggaccaatagtgttttcctacctcacagggatgttgtgaggacgggctgtagaagtaatagtggttaccattcatgtagttgtgagtatcatgattattgtttcctgtaatgtggcttggcattggcaaagtgctttttgattgttcttgatcacatatgatgggggccaggcactgactcaggcggatgcagtgaagctctggctcagtcgcttgcttttcgtggtgtgctgccaggaagaaactttgctgatgggactcaaggtgtcaccttggacaagaagcaactgtgtctgtctgaggttcctgtggccatctttatttgtgtattaggcaattcgtatttcccccttaggttctagccttctggatcccagccagtgacctagatcttagcctcaggccctgtcactgagctgaaggtagtagctgatccacagaagttcagtaaacaaggaccagatttctgcttctccaggagaagaagccagccaacccctctcttcaaacacactgagagactacagtccgactttccctcttacatctagccttactgtagccacactccttgattgctctctcacatcacatgcttctcttcatcagttgtaagcctctcattcttctcccaagccagactcaaatattgtattgatgtcaaagaagaatcacttagagtttggaatatcttgttctctctctgctccatagcttccatattgacaccagtttctttctagtggagaagtggagtctgtgaagccagggaaacacacatgtgagagtcagaaggactctccctgacttgcctggggcctgtctttcccaccttctccagtctgtctaaacacacacacacacacacacacacacacacacacgctctctctctctctccccccccaacacacacacactctctctctctctcacacacacacacatacacacacacttctttctctttcccctgactcagcaacattctggagaaaagccaaggaaggacttcaggaggggagtttcccccttctcagggcagaattttaatctccagaccaacaagaagttccctaatgtggattgaaaggctaatgaggtttatttttaactactttctatttgtttgaatgttgcatatttctactagtgaaattttcccttaataaagccattaatacaccaatcgtattttcttatttacaacagactgagagaattaatgctgttaacattggatcttttttcttttttttttttccttttttttctctctcgtttgctttccaggtcatgctgacctgttcagcttggactgtttcacatttgtttttaatgtcagtttaaatgtaattgtaaaagcatgtatgctctaaaatcatgtagttacttttttcagtggaaaagcctggtattcgaaagcatttccaggctctgcaatttcatatgagcaggtttttggtaaaatcttttgtccctcactcagggtggtatctggacagtgagcccctttcttctggctcagtagtcagagagaggagacttggagacagtttctgctggatcctgtgctttggcaaggatgtgcagcattgcatatcattctatcattaattatgtttactcctccatgaactaaaaaccattagactaaatagtccaacataaaccttgaaagataaaatttgatattcttttgcctggccatttctctgacccagaattggggctgggaggggattggagacttgggggaaagaatcaaggagccttcttgcctgggggaatttggcatgcacttattaatcccatttggttgcactccctactaatccctcactccatacctgccaaggattggctctgctccctgcttctcatccctgtcctagttcttcctcacctatctccatttcccactactgatccttctctccagtaagatgctattcaacccgatgaaatataaagagtagcaccaccctggaagtcaggataccttagttttagctcctgctctaccattatctagctgtgtgacctggggcatgacttaacctttgctcttcagtctgaacagtctttaagaattggtttggaggaggaaggaagggatagacaagatccaaggcctttgaactcttttttggaaatgggtccttttcttcaaacaaaatttgatgcagagtcccaaatttacctacagaataaaatactgctgttcttgtttgaaaggaagtggggtgcttggagccacatgctcaggcccactttgccccctctcaggaaccctcgaaaaaacttataggacttataggactgttggggatctgccaagtctctcttatgttacatttcagtccttgtgaaactctatatgtttcatcagttcactttttcagaaagttcacctgcttggggtaaaggtcatgaagtggagaatgtggggctcagtaactagcaatagtaaaaaacatcattgattggcttgcagaatttactctgttctaagcatcttacacacatactcatccgaaaactcacaacaaccttgtgaggtagatctgttattatcttaagattctgaaacctgccagcatgactctcaatctttgacttgagaccagttgcccaacatggaaggttatacttttcacagtttaccaccataagcagtctttcagagtgatttctagctagagatccattcttagaaaaagtcagaacctgcccattagcatacactgtcacatggtgcagagtaccttcactgggttcatctcatttcctcctaaaaatagtcctatgcagtagtccagtcatatcatcaccattatatagatgagaaaaactgaggtgtaggagaaatcaagagatctgttcaaggtcacacattccataagactctgaataccaccatcaagaataataaaccttttatgtgaaaagcattttagaacttcagtgtcattattgcattctgcctcctggagttcagtgcactttttcaccatgctttaatcttggagtcctggtggtacagaatctgccttctactctcagacaacaccacagtgtctttatccctcataacaaacttatgaattaagtaatgatattatccccattttacaaattagttaactgagataccaagaggctaagtcttgcccaaagtcacacagctagtcagtgatagagccggagttacaaatgaggcatcctgactccagaatatttgctcttaactactactctttatacatatgtaaggaaactaaaagcaaaagagggaaagatgtccctgaggccccacagtgagctcccctgactcacaatccagtattcctctgaccttctaatcctaaagttatacagtaaggtcccttgactctaatcctagtagatggaaagatggctggcatgatttaagccagaggccacaaactggcttccccagagccagaattcacctgcagaattctgtttgtccagcacagtgtttgtttagaaaattgacgtagactgcccctaggcagggcatcaatcactgtcattgtccccagccctccttatttatgtttgccaggcttttttactcatttatgtgtctgcctgacttgtgaaggtatttgagtttatgacttttagatttaagcattgcaatatataagcactgcacacatgcattcacaaaagtatagcctagtctagcttcacaaagaatttgtagccctacaccaaacacacctttatgtttacttagtgtttagaattagatttaagatcagaatttagtttcacaggcattcatgtgtggaagaacctcagttattgttttttgtttcatactgtctcacccttgctttccctgctgtgtctggacccctgtcaatcctgctttctgccattcttcatgcctgagttagggcccctgcaagccattcactggttaatctttaggaatgaatggagagtgaaaaccagtttggagggttcactgtgtcccaagcatcctctcatttagttctcataagtgtcctaagagacaggtagcagcacattcgttttataaatgaggaaactaaatctcagagaagctgaacaaagacctcaaagtcattaaggtagtaattaacggagccgggatttgaacgcaagactgttggactccagagcctattcttttgccctacaccacagttccttacaaggaagatgtattcattttctattactgcataacacattgccacaaatttagcagcttcaaacatttatcagctcactgttttgtaagtcagaagtctggcacagcatggctagattctcagttcagggtctctgaaggatgaaactgatgtgtttaccaggatgcattctaatctgaagctcagggttctcttccaagctcatgtaattattgcaggattcagttatttgtggttgtaggactaaggctccctcttcctttctggctaccagccaagggccattctcagctcttggaggctgccctctttccttatcatgtggaccccaacgccttcaaagccaacaacagagactcttccttgtgttgaatgtttctcactctacggatgtctttcctggaggatcccagtcccgtaagggctcacctgatgaggtcaggtacatcaagaatagccacccttcaaattcaactgaattagcaccttcattacatctacctagcctttttacaacagcatctaggttagtgcttgactgaatgactggaaactaaggtctcagaatctcggggaccgtcttagaagtcagcctactacagatgttgattcttttcatgtgtcaaatttcatagtgagatagggagaacagaaacatcacatccttgaccttaggtaaagggattcaaacttcctaagactttggaaacttcacgccactttcaccttttccttaatcatggttgagaaggcctatatcttggagtggccaggagtgagactggaacagtacctaaaggttaaggacgctaaagaagttacagattggttacatctgctcctccctaggaatgatccatggaacctgatttgaaatttttttctctggtgctatagatagctcccacaggggtctaatgccccagggctgaaaagttagttccccataggatccatccaggcatgatatcaggccaggtgttacaatctcctaaagaggaggtatggactggaaagccccttgccaatggccctttcttgtcactgctctgacccaagactaacagggcagagatagtgaactcacatactattaaaactatccacttatacttccccctttctctttgctttatcactccatttaagtaaaccaatgagtctctgccttgacacagtggcaagctgacctgtatcttatatgaaagaattagatttgactctggggctcaggtgcagagggcaggaggggcataaggatggccttcatggaagaaaagaagtccttggatactgagtaacagctgagactagcaagcctcattgtccaggattccaagtcgtctagcaacatcctggtctctgctgcagacagaacagaggatcccccggcagaatgaatggagtctgatttcaattacgttcagtatagtcactctctttaggcagagaagccagaacacctggtgcagctagggccactgtggtcacagggacaagcacactacctgggtcctggaggcaagtgggaatgcagtttttcttccttaagcagatgccatataggcctggggaggaggatgtgagaataccagccaagttctcattggcactatacagagaaaggggaattatttcatcttgatggattctccccacagtctctgcacatattgatcttacttgtaatgagtttgcttaggttcacgagtcatcatcccagggagatctgagtcattggtgggaaagtcgaggcgacagattatatctcactgatctcactgtcaccaattgctctgtgtgtccctccaccttttgaaaaagtccatggattcatttgtgtgtaattcatttggatttatttcttctttatcaatagctttagtggggtattgcaaatgggaaagttgccccagagaacagtgtacattcacagcattattcagtagaactttctgagatgatgaaaatcttctatatcttatgttgtacaatataatacagccactaactacatgtagcttttgaacactggaaatgtggcaggtgagactgagggattatatttttaattttttaatgttgtaattaatttaattttttaaaatttttgctttctattttatagtttaataattaaactaaacttacgtagcccacatgtggctagttggctactatactggacagtacaagtctagaaggatctcagagagacacatgctgagatacagcaggaataagtcaaaaagagagccaatgtaacatagggaattctggattgggaattagagccctggctctaatctcagctctgccactaggtgaccttgccctctctggcttcagcctccccatctttgacttgaaaggttaaactaactaacgtcgaaagtcccaaaatggtggctatggactgaattcaattttgggatacacaagtttcaggaattttttaaaaatctattaatgccttctaggtgtgtgtatgcacgcttgcagacatgtgcccatgcacaagcatgggaaggcagtaaggcattcatttcaattcaccagtgtactaaccattcacacacacacacacacacacacacacacacacacatgcacacacaccctactgtattgcctatgtagagcctgaagatcttttaatctgtcaccattggataagataatttctaaggacccttcctgttttgtcatgctgaaaatctttaagccactatagtgtcccaaatctattccagtttgggcagatgactggagtattctcatagcctcctgtctattcccttctggatttgatactagttatgaagtttggagtcaagggtgaagaagggaggcagggatgatataaccccagccccactcctcaactctgcttttgagttagaagtagggttcagggcttcagattccttggggaggcagtagagagaatatgggctttataatcagaagatgaggttcagatgattgggttctcaccttttttatagctgtgttacctcagtttattcatttgtaaaatagggataagaaatatctttaacctcctaagatcatgtggaattaagtgatgtaatgtgatgaagcgaggcacgcagaaggccctgaaaaaattagtagttacccttaaggggactaaatggtctggcaactcccgagctcaaagctagaaaggtccagtaatggggaagatggggtctttctgtaggaactgtagcaggggagcagatcctgtaggccaccagtctgtggagctgtgtccaagaactcatgtttgcaataagcccaccaaatgacaagttattgtggggttcaggcctctaactcaagaagatggtcttggcccagatcataccttgcagcctgtgcctttggtgggatgtgggtgttggcagtggctatgcatatctccttattactggctgtgccaaagccccgcagaaatgattgttggacaaagtcatcttgcactcagggctggttttccaggcttccttgttattttcccctgagttcttctgtgttcctcttgcaacaccaaccccactattttcctcttccctaccctagttgttggtccaaacatgtaatccattcttgcagtgatttattgggtgacaccatgactggagtttgcattgaaggacttctttttctaattagaactaaaagtcagttccaggctgggtgtggtggctcacgcctataatcccagcactttgggaggccgagatgggaggattgcttaaggccaggagtttgagtccagcctggacaacatagtgagatcccatctctacaaaaaatgttaaccaggagtggtagtgtacaactctggtcccagctacttgggagactgaggagggagaattgcttgagcccaggaagttgaggctacagtgagctttgatcgtgccactgctctccagctgggtgacagaggaagatcctccttcaaaaaataaataaaaactaaaaaaaaagtcagttccaggttgtatcttttttcacaggggccagacacagatgagagcaggttttgttgtatttatccatttaaattgagcaataaaattctctctttggtttctacctttcttatttattattattatgttaaagggattaaagtggttcatggtctttctcagtgcaactgcttatgctagacctcagaattatgaccttttcaattatttatatttctgtctatataaatactggaaaaaatagtacaaagtaagcatcggaatgcctaaggacctctaaattgtgtgtgtgagcacatggggaagatggttcttaaggtttgagttttggattattgtggttgtcttaaataatgttatttctatcattctttccaatgactgtctcctagcatagttcccattttacagactgatggcagaggcagaaagattctctcacttctttgatactattgaggacttcagcctttcaccgctcttctcccctttgctaaaaaagaaaaaaatcaatatgtatgttacagtgcatttttttaaatattttttattatactttaagttctagggtacgtgtgcacaacttgcaggtttgttacatatgtatacatgtgccaagttggtgtgctgcacccattaactccttatttacattaagtatatctcctaatgctatccctccacccttccccaaccccacaacaggccccagtgtgtgatgttccccttcctgtgtccaggtgttctcattgttcaattcccacctgtgagtgagaacatgcagtgtttggctttttgtccttgagatagtttgctgagaatgatggtttccagcttcatccatgtccctacaaaggacatgaactcatcattttttatggctgcatagtattccatggtgtatatatgccacattttcttaatccagtctatcattgatggacatttgggttggttccaaggctttgctattgtgaatagtgccacaataaacatatgtgtgcatgtacctttagagcagcatgacatataatcctttgggtatatacccaataatgggatggctgggtgcaatggtatttctagttctagatccctgaggaatcaccacactgacttccacaatggttgaactagtttacagtcccaccaacagtgtaaaagtgttcctatttctccacatcctttccagcacctgttgtttcctgactttttaatgatcgccattctaactggtgtgagatggtatctcattgtggttttgatttgcatttctctgatggccagtgatgatgagcattttttcatgtgtctgttggctgcataaatgtctttttttgagaagtatctgttaatatcctctgcccactttttgatggggttgtttgtttttttcttgtaaatttgtttgagttctttgtagattctgggtatttgccctttgtcagatgagtagatggaaaaaattttctcccattctgtaggttgcctgttcactctgatggtagtttcttttgctgtgtagaagctctttagtttaattagatcccatttgtcaattttggcttttgttgccattgcttttggtgttttagacatgaagtccttgccggtgcctatgtcatgaatggtattgcctaggttttcttctagggttttatggttttaggtctaacatttaagtcttgaatccatcttgaattaatttttctataaggtgtaaggaagggatccagtttcagctttctacatatggctaaccagttttcacagcaccatttgttaaatagggaatcttttcccaatttcttgtttttgtcaggtttgtcaaagatcagatggttgtagatacgcagcattatttctgagggctctgttctgttccattgatctatatctctgttttggtaccagtatcatgctgttttggttactgtagccttgtagtatagtttgaagtcaggtagcgtgatacctccagctttgttcttttggcttaggattgtcttggcaatgcaggctcttttttggttccatatgaactttaaagtagttttctccaattctgtggagaaagtcattgatagcttgatggggatggcattgaatctatgaattaccttgggcagtatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattttattctcttagaagcagttgtgaatgggagttcactcatgatttggcttctgtttgtgtgttattggtgtataagaatgcttgtgatttttgcacattgattttgtatcctgagactttgctgaagttgcttatcagcttaaggagattttgggctgagacaatggggttttctagatatacaatcatgtcatcggcaaacagggacaatttgacttcctcttttcctaattgaataccctttatttctttctgctgcctgattgtcctagccagaacttccaacactatgttgaataggaatggtgagagagggcatccctgtcttgtgccagttttcaaagggagtgcttccagtttttgcctattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttggttctgtttgtatgctcaattacatttattgatttgcatatgtggaaccagtcttgcatcccagggatgaagcccacttgatcatggtggataagctttttgatgtgctgctggattcagtttgccagtattgtattgaggttttttgcatcgatattcatcagggatattggtgtaaaattctctttttttgttgtgtctctgccaggctttggtatcaggatgatgctggcctcataaaatgagttagggaggattccctctttttctagtgattggaatggtttcagaaggaatggtaccagctcctccttgtacctctggtagaattcagctgtgaaatccatctagtcctggactttttttggctggtaagctattaattattgcctcaatttcagaacctgttattggtctattaagagattcaacttcctcctagtttagtcttgggagggtgtatgtgtcgaggaatttatccatttcttctagattttctagtttatttgcatagaggtatttatagtattctctgatggtagtttgtatttctgtgggatcggtggtgatctcccctttatcattttttattgcatctatttgatttttctctcttttcttctttattagtcttgccagcagtctatcaattttgttgatcttttcaaaaaaccagctcctggattcattgattttttgaagggtttcccatgtctctatctccttcagttcttctctgatcttggttatttcttgccttctgctagcttttgaatgtgtttgctcttccttctctagttcttttaattgtgatgttagggtgtcaattttagatctttcctgctttctcttgtgggaatttggtgctataaatttccctctacacactactttaaatgtgtcccagagattctggtatgttgtgtctttgttctcattggtttcaaggaacatctttatttctgccttcatttcattatgtacccagtagtcattcaggagcaggttgttcagtttccatgtagtagagtggttttgagtgagtttcttaatcctgagttccagtttgattgcactgtggtctgagagacagtttgttataatttctgttcttttacatttgctgaggagtgttttacttccaactcagtggtcaattttggaataggtgtggtgtggtgctgagaagaatgtatattctgttgatttggggtggagagttctgtataagtctattaggtccacttggtacagagctgagttcaattcctggatatcctttgtgtcttgttgatctgtctaatgttgacagtggggtgttaaagtctcccttgattattgtgtgggagtctaagtctctttgtaggtctctaagtaatcactttatgaatctggttgttcctgtattggtgcatatatatttaggatagttagttcttcttgttgaactgatccctttaccattatgtaatggccttctttgtctcttttgatctttgttggtttaaagtctgttttatcagagactagcattgcaatccctgcctcttttggttttccatttgcttggtagatcttcctccatccctttgttttgagcctatatgtgtctctgcacatgagatgggtttcctgaatacagcacactgatgggtcttgactctttatccaatttgccagtctgtgtcttttaattggagcatttaggttaatatttacgtttaaggttaatattgttatatgtgaatttgatcctgtcattgtgatgttagctggttcttttgctcgttggttgatgcagtttcttcctagcctcgatggtctttacaatttggcatgtttttgcagtggctggtaccggttgttcctttccatgtttagtgcttccttcaggagctcctgtagtgcaggcctggtggtgacaaaatctctcagcatttgcttgtttttaaagtattttatttctccttcacttatgaagcttagtttggctggatatgaaattctgggttgaaaattcttttctttaagaatgatgaatattggcccccactctcttctggcttgtagagtttctgccaagaaatccactgttagtctgatggcttccctttgtgggtaacccgacctttctctctggctgcccttaacattgtatccttcatttcaactttggcgaatctgataattatgtgtcttggagttgctcttctcgaggagtatctttgtggcgttctctgtatttcctgaatgtgaatgttggcctgtcttgctaggttgggtaagttctcctggggaatatcctgcagagtgttttccaacttggttccattctccctgtcactttcaggtacaccaatcagatgtagatttggtcttttcacatagtcccatatttcttggaggctttgttcgtttctttttactctttttttctctaaacttctcttctcgcttcatttcattcatttgatcttcaatcactgatacccttttttccagttgatcgaatcagctactgaagcttgtgcattcgtcatatagttctcgtgccatggttttcagctccatcaggtcatttaaggccgtctctacattgattattctagttagccattcgtctaatcttttttcaaggtttttaacttctttgcgatgggttcaaacttcctcctttagcttggagaaatttggtcatctgaagccttctctcaactcatcaaagtcattctccgtccaggtttgttctgttgctggtgaggagctgtgttcctttggaggagaagaggggctctgatttttagaatgtttcagtttttctgctctgttttttccccatctttgtggttttatctacctttggtctttgatgatggtgacatacagatgggattttggtgtggatgtcctttctgtttgttagttttccttctaacagtcaggaccctcagctgcaggtctgttggagtttgctggaggtccactctagaccctgtttgcctgggtgtcggcagcagaggctcagaacagcgaatattgctgaacagcaaatgttgctgcctactcattcttctggaagtttcgtctcagaggggtacctagccatgtgaggtatcagtctgcccctactggtgggtgtctcccagttaggctactcgggggtcagggagccacttgaggaggcagtctgtccgttctcagatctccagctgtgtgctgggagaaccactactctcttcaaagctgtcagacagggacatttaagtctgcagaggtttctgctgccttttgttcggctatgccctgcccccagaggtggagtctacagaggcatgcaggcctccttgagttgcggtaggctccacccagttcgagcttcccagctgctttgtttacctactcaagcctcagcaatggcgggtgcccctcccccagcctcactgctgccttgcagttcgatttcagactgctctgctagcagtgagcgatgctccatgggcgtgggaccctccgagccaggtgtgggatataatctcctggtgtgccgtttgctaagaccattggaaaagtgcagtattagggtgggagtgacccaattttccaggtgccatctgtcacagctttgcttggctaggaaagggaatttcctgaccctttgcacttcccgggtgaggcgatgcctctccctgctttggctcacacttggtgcactgcacccactgtcctgtacccactgtccaacaagccccagtgagatgaacccggtacctcagtcggaaatgcagaaatcactcatcttctgcgtcactcacgctgggagctgtagactggagctgttcctattcggccatcttatgaatcatgcatgttcaactatgagcaactatgtgtattcaatgggaaatggaataccataaaattgtcatatgttgagcccaaaatgataggatagaatttgatagtctgaggatggaaaggaccttcaaggccacttttaaaaaccccattcccatatgatgcttgaattcttaaccactgtgtgtctagtattttctcatttccagtgatatgtgtgcctgccaacctttccgtctccaagagctttaactatcaaaatgtatgtgtgtgtgtttttgtgtgtgcatgtgtgtgtgagtgtgcgtgtgtgtgtgtgtgtgtttagagagagagagagagacagaaagagaaggagagactaaaatccaattcactgttctttctgggacccaaagaacaagtctagtcattctccatttctagtctctttccctagcaatcggctagacatgctagacatagacacatgtacatcactcctttgaattacaacattcagtatttgtctatcacttatatgataaaatacaaacttagcttttatttttatttttttagagacagtgttttactatgtcacccaggctagagcatcagtggcacaatcatagcccactgcagcctggaacccctgggctcaaggaatccttccacctctgcctcctgagtagcagagactacagatgtgcaccaccagacccagctaatttggttttttactattttttgtggagatggtgtattgtcttgtggtgttgctcaggctgatcttgagctcctggcctcaagcactcctcccatctcagcctcccaaaatgctgggattacaggcatgaaccaccttacccagccaaatttcttaatatgatatacatgctcctttaaaatcaagcaccatctttgctttcaacctcattattaaccactttcccatatatgcaacatatgtttcagccatactagtgtctagtttttccctgaacactccttggtgcttttgtttatgccctttctgcccacctttgcctggtgaaatcctcatcaatcttcaaattctatcaaatactatcttccatataaagcattttctaaacccacctatgtaaaaagattagtgttttcctattttgttgatgcctccattgcagcattttccagtccaacgttttctagaattgattgtggccaggctaccagactgggccagggcctgtgtcttttctgtcacccagaagcaaaggtctaacaatggatatctgctgaatgaatgaacgaaaatgaatcattaatatattagtaaatacgttaattaaagttccaggtatgaatactgaaggctgcattcaggcagagctggatccaaggatatgctaggttggtctagcacaagaatcagagttttcctctgcaagctatgaaaaatttgggtttagcaggtatttgggatgatgaattatacatttaaccagtgttgaatgagcacttgtccttaaggagtttagagtctgtgaccagggagaatggtgattttcttagctagggcagtttttctaaaaaggtagttgcattgtgtgtttttgaccactgatgataaattcaagtctctcttccttcccaatagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggtaaggaaaagggaagtgggagcatgagataagggggatcatatttagtgaacgctcctatggaccagccaccatgtctggtgcttttctgcccattaactcaggcagtcttcatcataaccctgtgggagagggattgttacaagtctcaatttaaacatacagggatcgaaactcagaaagcaaagagaaagatagtattatcgggtgtcttatgtggcccacattgatgcacagcagtcatgctttcatattcaactcacaaaaatggtcagcaaattttccattaatcacaaatcacatagacatacccatatatgccttaggatgctcttctatatttgcacacacaggctcaccccaaagataatctctagtttgactgacattctgtcttcaatgtcatctttaggagctatatcatgggaactctcataatatggtatggtggaaagaacatgaggttgggaatcagaacacttcgggtctgctcttagctctgctagtaacttattgtgtgatcccttccccttctgggtctcaatttctctatctgtataatgtataaagcgtggtttgtatcaaattgatggtttccagtttttgaaaaaaggaacgctttttgcaccttaaactacctaaggaatcataatgagaggaaagattaggtaatagtgaaagaattaccaagtgttggtctaacagaagttggataacagaagttcctcagtgatggggaactcacttctttcttatgtcatctgttgtttaaacaagtctggttattaaaatattacagcttaaggaattcttagagatcctctatccaatgattcacaaactttcctttagcagccaagtgctttatttctcaaaagaattgtacacagatacaagtggagctagtttatttaaagccagagcctgtagcttgggcctcaccagttcagcctctttctctctatcccagggaagccctaggtcactcttgcaaaatcttagggctccaaggaacacagtttgaaaaccagtgaagtatatgccctttaaaggttctcctaatcctgcaattatgattcaaagattcttttgaaataacaacaaccaaaccttctcttgtggagtcaaagattaacctgcctttcaataataactgccattcaggtagaaatttatagtgaacagagcaattttgtatgtattacctgaattgattcttataggaatcctataacatgagattctttctcttattttacagaccaaatagggaagctgtgagaatgatgtgattggcctatagttacatagtcagaaaatagcaggaccagaacttgagcccaggttctctcctgattccaaattctctctattccactccacctgtaggctgtagcaccactgcagttctgtagctctgggctttacagtgaggggccaaggcttcattgaaggccacttgggtcatagtatgggcttgttgcatttgaagacatttcatgttggctgtcaagtcttagatttgtatttccaactcacagggcctggtcacagccctaaccatctcttataccttctcagcttgggaagctgaggtcgactagccaataagaacactgggaaggaaacccaaggactctgactggatatgctctgtgccaaaacagagggttcactcagagaggaaaaatataaaaaagaaaaaggagaaggttgctttaattcttatcactttttcatctggatattttgatatcatgtgtttgacagagattcaaagtttaatcttcccaagcagtttccaaacacttatctcattttataggctacagagctttttcatatatatgatcccacttaatctttacaacaattctatgaatcatagagactattatttccatttcacatgccaaggctcaaagaggttaactaacttgctccatttggtcacttaacacatggaaccagaacttgacctagaccttcgggtttctaaattggttatcttgacaataacctagtgcaaaacactatagcagaatttgtatgacttgggatcactggggctttccttggcccaaccaccaagatggaaagccccctccccttacattaacaaatctgcaagccaatatcagttcaccatctagcttgccagactaaatgatttctgaccccaagtcttttaaaagaatagcttcaaaagaaagccaattaccacattcacaagaactgttcttcatattatctataattacctacaagtacaagtaatttgctaattcaatagattgagttcttgacctgtaagatgaactgtgctaggcccctaataagataaattttgttttaagttttctgtgacagtaaagatgtatgaaaattgcctagtagagtacctggcacattaataaatgataactgttaatttggagtgggtgagtagactgggtgtgcacagtatatttagaatcaaatttatctggtttggaatcctagctatggactagttctgtgaccttgagcaaatcacatgtcttctctgtgcttctgtgtcctcatttgtaagatgatagaataatcactacctttcaaattgttgtcaacaaaaagattatgtataaagagcacctagtaacgtagcctgaaacatagtcaatgctctgtaaatggtggtttattattatgagacttgaatgctaagccactgctttcacgaaactcaattttagctaccacttgccttgcctagaagctcatgcatggaccccaaggtgaaattgtgttctctgaagacctcggctggcagatgtactacagcagcaaagatttccaaactggcctttctttgagcccattctcccagactagacaggagactacaagtttctgctgcacatgaaaaaaatatgatgtcaatcggattctagtgagaaaacagagtctcaaagaaactgcttctgctccctagcgtgtttaatgtgtttcagaacctgagaatgactcctctctgtttctccagaacagcctaacacagtggcaaatgggtgttgagtgaatgcatacttaaggaaatctgtagggttgcagctactctttcctcaagtaatcccttgatagtcatgtaggctacttcagagattgggcattagagaacagagtcaggtattataatcagattagactctagggaggttagccagccatattgctgatatgtgcacagttactgggtttgagtgctaagcagctctcattaaggacggttaattaatattatggccaaattaagctttcccttttctctcctctttgttagttcggtggcattttagggagaaaaaaataagcatcagtatggacaatttgcttgatacctgtacaatttaattctcatccttccatgtgccttcacattcacacattccaccagaagaccaaggttcaccagccaaaagcttttcttgctccccactgcctcctacccaagatattcagggtcaacctcccaggcctcttctctaagagatccttggttgctacatgcttagaccctgcttcttatttcctgctgagaagggtcagtccaaggcattctgtgctacagaagggttccaagcaggaactactctgggatctgaggctccagccggtctgtcagcgtgtcattacagtgaaggtgggaagcacaggcctgggagctaagactgctaagatgagggactctagaatccctgatacctggaaggcctaggatctaaaagaaaagaacagggaaatggggctatatgagtggacagggaccaaccaagcagaacaatgtgtctggataatgtagacttcagacctgatcctatggctgacaaaagctggtgaccttggtagttcctgagctgtaaccttcattagtggagtagaaaaaacactggagaagagaatcagaacacctgggttctagtattagttcagccacatataaaccatatgaccttgggtaagtcagtttatttctctggccctcatgttccttgttggtaaaataagtgccacatcacctaacctctgggattattgtgagagttaaattaggtcatcaacaggaaagtgagaagtttgatctaaatttggggaagcattcctaatgaggtatgatgacaaaatttcagataattctggatttgttggtgagaagagagagtgttggtagggacgagctctgaggtgatgcctttataactttaagcatccaactgtttcaaaaactccaggagaacatggccatgtctgttctacctgtgtattattgtagacgtagcttctgggagcctctgctctctgagcttaagggaggtaatttggagatcatttaattctcattttacaaaaggaaaaaaaattgagggtctttaggccatttgtttaggtaatatttcttaagtgcccactcaaatacgtggactgtactaagtactagggaggtaaagataaataagaagatatggtccctgtcttcaagaagctccaagtcttgtgggggagacagacatgtatatacatagacttcaatgctgtgtaatgactgctataattgggtgaggctacacaaggtgcaatgagaatgtaaaagaagaatctttaagccttcttcttggatgagttgggaaagccttcacagaagaggtagcctttgagtgaagacttgaaagatgagtagtgtttaccggatgaaaggcctgagaaggaggaatgcattctaggcaaaagtaactgcctgtgcagagataacagagatatagaggcatgtgagagcgcaagtggcaagagatcagtctaggtaggcaggtcataaagggcctattcatgtataatgatggcagtaagatgaggatggcagtagggtgggaaattagtagggccagggtacctattgagtagaaaagaatggagaggaaatgccaggcagaaagaggatggacgcaagagagggaacatgaaagtggtgaacaggtggcagtggctgtcaagacatctctccataccctgtacactgtatgtaatatccatctcccagggttgttagaagggtcaaaccagatcgtagctggaaaacagctttgtgaagtgaaaactgctgtttatgtgggggaaatgattgttaaactgcatctttggaaaggtgaagtgatcaagagcacagaccttggaatctgactgctttgctttgtaacttggtctgccaattactagctgtatgatcttggacaagttccttaacctctctctgactcacttgtactggttcacagaatggagataataatagtacttaccttactcattgttgtgaatgttaaatgagataatataagtaaagtgcttagaaaagagttaaatgtaccccataaatacatacaactatcatgtacccaaaattatttttaatttttttaaaaaagagcaatccaatagcaaaagaaaaaaagagttcactcatataagcagtcaataagtgttagattatttttctcttacaactgacaatgccctttttgtctccatcatcatctcatttgagcagctcagggaagtagggaggataaggaatattatcctcaccatatagtttgtgcttttccccaccaccccttaatggccagcctggatggtccctggggatccttaggggatgcccgaataccagagcatctctgcccaacagggactcagacttagctcaacccgtcagtacccagactgaccactgcctctgcctcttcttctccaggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaagtgctcctggggcccagacctcactaaaatacagcagcttggccagacctggttggtggtgatggtgatggggtgacagtgaagcttagctcatttgatctgcagttgtcgcagcggatgccccagccagccaatccagtatgaggcggctttgccctggctttcagccaactggcaggagcccaggaggatggtgctgagaccacccctttcacacccaagaaccaatcctagtcatatttctggtctgctttgcagcttatctcaaaaccacatggaaagattcctccccttcacatataaaagaggcagaaagactctggctttaagggctggagtttcttgggttcttttgctaccaccaaaggctacttctagtcaccatttgctgagcaactagtttgtgccaagactatgctagatactttctaaatcctagctcattgagtcctcatggtgacctgacctcacctttttatagataacactatttttttatggatggggaaaatcaggctcagcaaaataaagtgactcacccaaagtcacagagctagtgcctgttggagacaagattcaaacgtatgtccctgtcgatctcagctcttctgcgtcatggtggtaactgatgggaaggagtacctctaccgctctctggctgtgtgaccttggtactgccattttccttcccttaaacagctttaattaatacctgccctgccaccagctccatataacatcatgaatttggccagtggctcagattttggaattacatttttctccactaaaatctcagttctactattttcttagtcagcatctttgggaaagacctttaacttttccgaccctcaatttcttcatccattaatgataacagaaccttcataagtaatttcttatgataactaaatgggaattgacagatgtggaatgtctggcccatagtaggcaagaaggaaaaaaaaagtccctttctgattcaccctttccctaatagtgatacattttttttccccgagatggggttttgctctgccacccaggctggagggcagtggcgcaatgatctcagcccagtgcaacctccacctccctggttcaagcaattctcctgcctcagcttcccgagtagctgggattatagatgcccgccaccgtgtccatctaatttttgtatttttggtagagacgggatttcaccatgttagccaggctggtctcaaactcctgacctcatgatctgcccgcctcagccgggcatgataatcttttctatgtctgctgtatgaggtccctcgatggcattgtgaatggagctggccagagaaatcttcccaaggaccttgagctagtctcaccacagagaatccttccagtcaggacaggaattgaccttcccccctcttcagccctctaacccagaagagtcttaaaataaaatctacaggccaatggttccttccagtacagcactgcaatgcgagggagagtgagcgtccccagctgccctctcccaaccctgccagcctggtagccaaaagctaagaataaccactaggcttttggcacaaactgctttgtggttttcagatctccgcaaagttgcctatgatgccatcttctggggcaggccttgaaaagccccctaactgttcatctcccatccttaaacccctgctgcccttaagcagttgaatcaactccatgagcacctgctctaccttccccagagccctgagacctttggagctttgaaaagtgataattggttgttctctaaatcctcatttccttctctgcctctaagtaagcatgtggcatcccacctcggcttcctggtccagtcttgttcatcttataaaaaggcctccctacggggtcagaggcctagacccatcaaacccagggctcctgaaacaataggacccctattcctcctgtaggaagccactgtgttagagctctcagggtgtctacaaacatctagataagtgtttctcaacatggattctgttgacatattgggaaaaataattttgtcattatgtagaatatggttaacatacctggcaccagcctactctataccaaataggattccagtcattctgacagcccaaactgctcccacacatttctgacacccactgaagaggcagtactctccagttgagtgcaactaatccctgccagccttcctaaggtgctaatggggagcctcagacccaaagagagagagaagaacttgtccaatgtaggtcaacccatttgctgatctcttcaacaccaagctctattatcagccctgtttttttctttctttctctctttgtagagatcacatgttgtgaggataatgagcttgaaccttagctgtgtgaccttgggcaaattactgaacttctatgtgccgcaaattttatctggagactgctgaagagtattataatagcacctttctatatgtcatttattgaacacctgctatgtgtcaggcactgtgctcagtgttttccaatcttcatttctcctcttattttctctcttgcactcccaccaaccttgttctcttcctaaattccattcctgcctcatttttctaccctccattctcctctctcttccttcctttaactgtctccctagtatttttccccttttccccctttcttttccccttcccccatgaatttcttctctttcctttccccttctctttcctccattccccactttttctgcccctgaggcctgcagcaatgttaaaggaatcctcattccagcattgtgatttcaatggtaaaaagattgcagcattgtcatcaacagaggtgggaaagtacattggagactggagcagagccagacctcagggtcagccaatcttactaaaaaattctctacagtgaaagagcttggagcaacactgttctgctcaattgatttgtgataccatctaaacacttcctctttctagttgggcttcagcctgagttgaataattctacaccatctgccctcttctctctttctccaggacagccaagatctctctgagataggatgctgagcttccacccagacaataccaggcctgctcatcctatggagtaggctagtggcttggaaaccaaaatgtcaaaccatagcctttaggctccatctgggaggtctttgtcctcaccacttaagtgggtgtcaaatttccttccctttctgcacacgctgcacaatcaatttctgtcttacacacacacacacacacacacacacacacgatttttgaagtgctgaaaactggaaggcctactagcatgaggatgctgtgtcttctcttagaggtatgccatggtcagccatggaaccgagaggttgctcttccttgaaaagctggccaagcattggccacttccccatataatttataggtgataatgtggtgatctgttcagaagtgactataataaatgcaactcacatatgtctacagtttccaaactgtggtaaggagcagccagcatatgagggaatgggctccccttcagcaggggacatttaaactagacattcaaaaacactccctggcagatttaacattggaactcgttttgaaagaacaatgtggaatctccttcactgggagtttttgaataagtatgaaatttctagtattccaggccagaggcaaaggggtcaacaggatgaccaaacacttcgggtcatttgcaaatcttgatgtcctgatgttaagagctgactactggggcttctcctaaaaatccttcatgttgagctgcctggaaggcaggttctcattctggctgtagctgagatgttagaactgtagtcagggagaccatgtgcctcccccattgtgttcatttggttaggctttcctgtccctgactcagaaaacagaaggggcacagagacctggaaattccatgtgctaacccatatcctggccagagaagatgagtagttatcagggtgtcaggattttggaaaacagagagagaaaaaaaacaaacaaacagacaaacaaacaaaaaaaccttttcctggtccctggagcaccagcaggagaaacagcaagctcttcttggaaaacctggcgagggatggcaatcagagacattccctctgggcttattgtaaacttcccctcattcctttttcctctgtgtatctccttcccaggtaccgcatgcacaagtcccggatgtacagccagtgtgtccgaatgaggcacctctctcaagagtttggatggctccaaatcaccccccaggaattcctgtgcatgaaagcactgctactcttcagcattagtaagtgcctagaagtgcagggaatgccccctgagggcacagagattcagagaggaccacttttgccattaaaacattattagggaaaagccagctcctggacatttcccttcttcattccccctccccatccccactctactctctctcagcatcattttcctaacaagaaacaatttcatgactagaagccaatttatttgctagaagtcaacctccatcagattccccacctatccccagtctgtctttgggacaaggcctttttgactggttacagcaggtctctgaatttttccatagcttctgctatagaaacagacatgggccaccttgtattctttgcagggcagtagagcaggaggcatttcctcctggaaagatttcctcttctgccaacaggaggagatctatgtaagcaactcagataggatttgtatggcagccaaggaacttttctttaatatcttttctaagagccctctcttagcccctacggagggagaagggcaaaatttgatattcaaagctatgtgttttggttatctaaatcagggttttactgtgaatgacataaaagcttaggtcctaaaaaatgagtatctgagaagagtagaaaaagaaaaggttcaggaaatttgatttacttgactcctttcagatcggatccagctatcctttcccctgagatctccctgacagactgaaggccccaagcacacagacttcaactaacaggaagccaagtagatggttccctgtgggggtgggggtcaagtctgtggtcagaaaacttggtgctttgtctaatgctccttcgtgggcatgcttcccctccccattctgtcttcatcccacatcagttccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctgtaagcaaacgatggagggtgctttatcagggagaacagcctgatagagccaatgataatatgcttctctagagtctggcaccacctgttgggaggtgcttccattcccctctggctttgagtgtggtccaggaagaaaatgtggtgaagaaaagaacacgggtcacagtgtcccagctggatattgtgaaaggggtggaggagttgagaacagagcagttgggactcagggaagggacttgcagcagatgaattctctaggcagacaaaacagacctggatgtttttcccctcttctttgagtcatgttcatgtgagtttgtctgtctgtgtgtgtgtgtgtgtgtgtgtgtgtgtgtgtgtgtgtgtcagagagagagagagagagagagagatggagtgcggaggcttgggtgagagcacaagctggagaagtcttgagtcagagagcttacaatggtataagacatctcttgggagccctcagtgactccatggagaccatttctttctctctctctcgctgtctctctctaacacacacacacacacacacgacctcatgggggaggaccaaggaagtacggggaagggggaggaaacaaaaggctgaaagaccaaaaatcagaggttggggaagaggctagcagaggccacctccttgtcaaccctgtttttctccctcttattgttccctacagattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaacaaaaaaaaaaagcaaaaacaaaacaaaaaataagccaaaaaaccttgctagtgttttttcctcaaaaataaataaataaataaataaatacgtacatacatacacacatacatacaaacatatagaaatccccaaagaggccaatagtgacgagaaggtgaaaattgcaggcccatggggagttactgattttttcatctcctccctccacgggagactttattttctgccaatggctattgccattagagggcagagtgaccccagagctgagttgggcaggggggtggacagagaggagaggacaaggagggcaatggagcatcagtacctgcccacagccttggtccctgggggctagactgctcaactgtggagcaattcattatactgaaaatgtgcttgttgttgaaaatttgtctgcatgttaatgcctcacccccaaacccttttctctctcactctctgcctccaacttcagattgactttcaatagtttttctaagacctttgaactgaatgttctcttcagccaaaacttggcgacttccacagaaaagtctgaccactgagaagaaggagagcagagatttaaccctttgtaaggccccatttggatccaggtctgctttctcatgtgtgagtcagggaggagctggagccagaggagaagaaaatgatagcttggctgttctcctgcttaggacactgactgaatagttaaactctcactgccactaccttttccccacctttaaaagacctgaatgaagttttctgccaaactccgtgaagccacaagcaccttatgtcctcccttcagtgttttgtgggcctgaatttcatcacactgcatttcagccatggtcatcaagcctgtttgcttcttttgggcatgttcacagattctctgttaagagcccccaccaccaagaaggttagcaggccaacagctctgacatctatctgtagatgccagtagtcacaaagatttcttaccaactctcagatcgctggagcccttagacaaactggaaagaaggcatcaaagggatcaggcaagctgggcgtcttgcccttgtcccccagagatgataccctcccagcaagtggagaagttctcacttccttctttagagcagctaaaggggctacccagatcagggttgaagagaaaactcaattaccagggtgggaagaatgaaggcactagaaccagaaaccctgcaaatgctcttcttgtcacccagcatatccacctgcagaagtcatgagaagagagaaggaacaaagaggagactctgactactgaattaaaatcttcagcggcaaagcctaaagccagatggacaccatctggtgagtttactcatcatcctcctctgctgctgattctgggctctgacattgcccatactcactcagattccccacctttgttgctgcctcttagtcagagggaggccaaaccattgagactttctacagaaccatggcttctttcggaaaggtctggttggtgtggctccaatactttgccacccatgaactcagggtgtgccctgggacactggttttatatagtcttttggcacacctgtgttctgttgacttcgttcttcaagcccaagtgcaagggaaaatgtccacctactttctcatcttggcctctgcctccttacttagctcttaatctcatctgttgaactcaagaaatcaagggccagtcatcaagctgcccattttaattgattcactctgtttgttgagaggatagtttctgagtgacatgatatgatccacaagggtttccttccctgatttctgcattgatattaatagccaaacgaacttcaaaacagctttaaataacaagggagaggggaacctaagatgagtaatatgccaatccaagactgctggagaaaactaaagctgacaggttccctttttggggtgggatagacatgttctggttttctttattattacacaatctggctcatgtacaggatcacttttagctgttttaaacagaaaaaaatatccaccactcttttcagttacactaggttacattttaataggtcctttacatctgttttggaatgattttcatcttttgtgatacacagattgaattatatcattttcatatctctccttgtaaatactagaagctctcctttacatttctctatcaaatttttcatctttatgggtttcccaattgtgactcttgtcttcatgaatatatgtttttcatttgcaaaagccaaaaatcagtgaaacagcagtgtaattaaaagcaacaactggattactccaaatttccaaatgacaaaactagggaaaaatagcctacacaagcctttaggcctactctttctgtgcttgggtttgagtgaacaaaggagattttagcttggctctgttctcccatggatgaaaggaggaggattttttttttcttttggccattgatgttctagccaatgtaattgacagaagtctcattttgcatgcgctctgctctacaaacagagttggtatggttggtatactgtactcacctgtgagggactggccactcagacccacttagctggtgagctagaagatgaggatcactcactggaaaagtcacaaggaccatctccaaacaagttggcagtgctcgatgtggacgaagagtgaggaagagaaaaagaaggagcaccagggagaaggctccgtctgtgctgggcagcagacagctgccaggatcacgaactctgtagtcaaagaaaagagtcgtgtggcagtttcagctctcgttcattgggcagctcgcctaggcccagcctctgagctgacatgggagttgttggattctttgtttcatagctttttctatgccataggcaatattgttgttcttggaaagtttattatttttttaactcccttactctgagaaagggatattttgaaggactgtcatatatctttgaaaaaagaaaatctgtaatacatatatttttatgtatgttcactggcactaaaaaatatagagagcttcattctgtcctttgggtagttgctgaggtaattgtccaggttgaaaaataatgtgctgatgctagagtccctctctgtccatactctacttctaaatacatataggcatacatagcaagttttatttgacttgtactttaagagaaaatatgtccaccatccacatgatgcacaaatgagctaacattgagcttcaagtagcttctaagtgtttgtttcattaggcacagcacagatgtggcctttccccccttctctcccttgatatctggcagggcataaaggcccaggccacttcctctgccccttcccagccctgcaccaaagctgcatttcaggagactctctccagacagcccagtaactacccgagcatggcccctgcatagccctggaaaaataagaggctgactgtctacgaattatcttgtgccagttgcccaggtgagagggcactgggccaagggagtggttttcatgtttgacccactacaaggggtcatgggaatcaggaatgccaaagcaccagatcaaatccaaaacttaaagtcaaaataagccattcagcatgttcagtttcttggaaaaggaagtttctacccctgatgcctttgtaggcagatctgttctcaccattaatctttttgaaaatcttttaaagcagtttttaaaaagagagatgaaagcatcacattatataaccaaagattacattgtacctgctaagataccaaaattcataagggcagggggggagcaagcattagtgcctctttgataagctgtccaaagacagactaaaggactctgctggtgactgacttataagagctttgtgggtttttttttccctaataatatacatgtttagaagaattgaaaataatttcgggaaaatgggattatgggtccttcactaagtgattttataagcagaactggctttccttttctctagtagttgctgagcaaattgttgaagctccatcattgcatggttggaaatggagctgttcttagccactgtgtttgctagtgcccatgttagcttatctgaagatgtgaaacccttgctgataagggagcatttaaagtactagattttgcactagagggacagcaggcagaaatccttatttctgcccactttggatggcacaaaaagttatctgcagttgaaggcagaaagttgaaatacattgtaaatgaatatttgtatccatgtttcaaaattgaaatatatatatatatatatatatatatatatatatatatatagtgtgtgtgtgtgttctgatagctttaactttctctgcatctttatatttggttccagatcacacctgatgccatgtacttgtgagagaggatgcagttttgttttggaagctctctcagaacaaacaagacacctggattgatcagttaactaaaagttttctcccctattgggtttgacccacaggtcctgtgaaggagcagagggataaaaagagtagaggacatgatacattgtactttactagttcaagacagatgaatgtggaaagcataaaaactcaatggaactgactgagatttaccacagggaaggcccaaacttggggccaaaagcctacccaagtgattgaccagtggccccctaatgggacctgagctgttggaagaagagaactgttccttggtcttcaccatccttgtgagagaagggcagtttcctgcattggaacctggagcaagcgctctatctttcacacaaattccctcacctgagattgaggtgctcttgttactgggtgtctgtgtgctgtaattctggttttggatatgttctgtaaagattttgacaaatgaaaatgtgtttttctctgttaaaacttgtcagagtactagaagttgtatctctgtaggtgcaggtccatttctgcccacaggtagggtgtttttctttgattaagagattgacacttctgttgcctaggacctcccaactcaaccatttctaggtgaaggcagaaaaatccacattagttactcctcttcagacatttcagctgagataacaaatcttttggaattttttcacccatagaaagagtggtagatatttgaatttagcaggtggagtttcatagtaaaaacagcttttgactcagctttgatttatcctcatttgatttggccagaaagtaggtaatatgcattgattggcttctgattccaattcagtatagcaaggtgctaggttttttcctttccccacctgtctcttagcctggggaattaaatgagaagccttagaatgggtggcccttgtgacctgaaacacttcccacataagctacttaacaagattgtcatggagctgcagattccattgcccaccaaagactagaacacacacatatccatacaccaaaggaaagacaattctgaaatgctgtttctctggtggttccctctctggctgctgcctcacagtatgggaacctgtactctgcagaggtgacaggccagatttgcattatctcacaaccttagcccttggtgctaactgtcctacagtgaagtgcctggggggttgtcctatcccataagccacttggatgctgacagcagccaccatcagaatgacccacgcaaaaaaaagaaaaaaaaaattaaaaagtcccctcacaacccagtgacacctttctgctttcctctagactggaacattgattagggagtgcctcagacatgacattcttgtgctgtccttggaattaatctggcagcaggagggagcagactatgtaaacagagataaaaattaattttcaatattgaaggaaaaaagaaataagaagagagagagaaagaaagcatcacacaaagattttcttaaaagaaacaattttgcttgaaatctctttagatggggctcatttctcacggtggcacttggcctccactgggcagcaggaccagctccaagcgctagtgttctgttctctttttgtaatcttggaatcttttgttgctctaaatacaattaaaaatggcagaaacttgtttgttggactacatgtgtgactttgggtctgtctctgcctctgctttcagaaatgtcatccattgtgtaaaatattggcttactggtctgccagctaaaacttggccacatcccctgttatggctgcaggatcgagttattgttaacaaagagacccaagaaaagctgctaatgtcctcttatcattgttgttaatttgttaaaacataaagaaatctaaaatttcagatgaatgtcatcagagttcttttaattagctctttttattggctgtttttattgaagtcaagagttggtatcatgcccggttgcgttttatgctattttgattttcatatatttttaaaagtctttgcacaagggttacaaatttgccctgtggtggccttagcataagctgacctgggaccaccaaaataacaaggaatttgggctagaaagcacagatggacactggtgacccatcacaacttctcttgaaaaaccccaaacttgtcagctggggaaaagccacacaaagcccagctgcccaccttcacatccttatccttgtaggagcataaaatggtgtcatcactgcccagttctaaccaagcttcagttaaagaatgggtaccttcacatcttcactatttttcaggggccttaccgtccttgaccacccaagtaaaatctaaatcagccttcttttgggttcttcagttcaagcaaggcctcttcttgtggcctctcagtattaatatttatgaggttgcagattgaatttttgggcctgagatacaagccatcaatgaggtgtgacaaagcatgtcaatgaataataagaaaattatctattcttccatatcctcccctgtaataagggttgtcagaatgccttctttctgggctgggttgaggattcagtgagaacatatgtgacacagctggtgggctattaagctctggctttgctccctgttaaaatgccagaacccttgagagggatcccacattgagccatgtttatcactgaccaccttagaatggatggatttctcagatttttcctgagatcaatgcttgatggagaggagaggagaacaatagattcttgggatgtgtgttatgcatgtgtttaagtaagagacagagagtatgtttatttgcaggttgtgtgtgtaaagtcagagcctgcctccagaggatcttctctaaccaccattgcttaggtcctgttcgtttgcatctacagcgaatgaccttacagccatctgacttggcttcactcaccactcagctcctgcctaaacagacgaggtggttagcatccaccataagttttccaaggagtagcaaagcacaaaggacacctattgggttgaaaagagcctagaggcatgagtcctgtgtgtgacttgttcatagtcatgcagctagtgtatagctaggattctcccctgctgatttactatgtgacactaggcagcaatctgcccttgctggacctcggttttctaatctgtaaaatgtgtggagtaaaactacatgagatgggaagtcccttctagtgcagatgccatggttattgaaaactgcagcaacatctttcttaatcgtaaggggaaagaaaaagaccatttactactcctagaacagttttggagctagaatattcacatttgcactcaataattatttacaaaacaactagtgtggagagggtcaaaacaacagctgagtcctgtgtaatagatattgtcaaccccttgatggatgaggaaggggctcaaagggaa

SEQ ID NO: 2 - DNA, 6489 bp, homo sapiens
aggtacctttggggctggctttctcaaggaagcccagctccctgtgattgagaatgaagtgtgcaatcgctatgactgggattgggacacactttctgggcactgctggccagtcccaaaatggaacataaggaagtggttcttctacttcttttatttctgaaatcagcagcacctgagcaaagccatgtggtccaggattgctaccatggtgatggacagagttatcgaggcacgtactccaccactgtcacaggaaggacctgccaagcttggtcatctatgacaccacatcaacataataggaccacagaaaactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatcctgtggcagccccttattgttatacgagggatcccagtgtcaggtgggagtactgcaacctgacacaatgctcagacgcagaagggactgccgtcgcgcctccaactattaccccgattccaagcctagaggctccttctgaacaagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgctggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgctggcctgaccaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagatccaagcacagaggcttcttctgaagaagcaccaacggagcaaagccccggggtccaggattgctaccatggtgatggacagagttatcgaggctcattctctaccactgtcacaggaaggacatgtcagtcttggtcctctatgacaccacactggcatcagaggacaacagaatattatccaaatggtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatggtggcctgaccaggaactactgcaggaatccagatgctgagattcgcccttggtgttataccatggatcccagtgtcagatgggagtactgcaacctgacgcaatgtccagtgatggaatcaactctcctcacaactcccacggtggtcccagttccaagcacagagcttccttctgaagaagcaccaactgaaaacagcactggggtccaggactgctaccgaggtgatggacagagttatcgaggcacactctccaccactatcacaggaagaacatgtcagtcttggtcgtctatgacaccacattggcatcggaggatcccattatactatccaaatgctggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaagcaccacctgagaaaagccctgtggtccaggattgctaccatggtgatggacggagttatcgaggcatatcctccaccactgtcacaggaaggacctgtcaatcttggtcatctatgataccacactggcatcagaggaccccagaaaactacccaaatgctggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcatggaggctcattctgaagcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgatggcctgacaatgaactactgcaggaatccagatgccgatacaggcccttggtgttttaccatggaccccagcatcaggtgggagtactgcaacctgacgcgatgctcagacacagaagggactgtggtcgctcctccgactgtcatccaggttccaagcctagggcctccttctgaacaagactgtatgtttgggaatgggaaaggataccggggcaagaaggcaaccactgttactgggacgccatgccaggaatgggctgcccaggagccccatagacacagcacgttcattccagggacaaataaatgggcaggtctggaaaaaaattactgccgtaaccctgatggtgacatcaatggtccctggtgctacacaatgaatccaagaaaactttttgactactgtgatatccctctctgtgcatcctcttcatttgattgtgggaagcctcaagtggagccgaagaaatgtcctggaagcattgtaggggggtgtgtggcccacccacattcctggccctggcaagtcagtctcagaacaaggtttggaaagcacttctgtggaggcaccttaatatccccagagtgggtgctgactgctgctcactgcttgaagaagtcctcaaggccttcatcctacaaggtcatcctgggtgcacaccaagaagtgaacctcgaatctcatgttcaggaaatagaagtgtctaggctgttcttggagcccacacaagcagatattgccttgctaaagctaagcaggcctgccgtcatcactgacaaagtaatgccagcttgtctgccatccccagactacatggtcaccgccaggactgaatgttacatcactggctggggagaaacccaaggtacctttgggactggccttctcaaggaagcccagctccttgttattgagaatgaagtgtgcaatcactataagtatatttgtgctgagcatttggccagaggcactgacagttgccagggtgacagtggagggcctctggtttgcttcgagaaggacaaatacattttacaaggagtcacttcttggggtcttggctgtgcacgccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttga

SEQ ID NO: 3 - DNA, 14121 bp, homo sapiens
attcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaacaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctcaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctgaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtagtggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttgacccaccaatacaagttgaaggagactattcagaagctaagcaatgtcctacaacaagttaagataaaagattactttgagaaattggttggatttattgatgatgctgtgaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtcgaaatgaaagtaaagatcatcagaaccattgaccagatgcagaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattactcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacacttgcacaccgtgacttcagtgcagaatatgaagaagatggcaaatttgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaaaaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcaatgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcata

SEQ ID NO: 4 - DNA, 3964 bp, homo sapiens
ctactccaggctgtgttcagggcttggggctggtggagggaggggcctgaaattccagtgtgaaaggctgagatgggcccgaggcccctggcctatgtccaagccatttcccctctcaccagcctctccctggggagccagtcagctaggaaggaatgagggctccccaggcccacccccagttcctgagctcatctgggctgcagggctggcgggacagcagcgtggactcagtctcctagggatttcccaactctcccgcccgcttgctgcatctggacaccctgcctcaggccctcatctccactggtcagcaggtgacctttgcccagcgccctgggtcctcagtgcctgctgccctggagatgatataaaacaggtcagaaccctcctgcctgtctgctcagttcatccctagaggcagctgctccaggtaatgccctctggggaggggaaagaggaggggaggaggatgaagaggggcaagaggagctccctgcccagcccagccagcaagcctggagaagcacttgctagagctaaggaagcctcggagctggacgggtgccccccacccctcatcataacctgaagaacatggaggcccgggaggggtgtcacttgcccaaagctacacagggggtggggctggaagtggctccaagtgcaggttcccccctcattcttcaggcttagggctggaggaagccttagacagcccagtcctaccccagacagggaaactgaggcctggagagggccagaaatcacccaaagacacacagcatgttggctggactggacggagatcagtccagaccgcaggtgccttgatgttcagtctggtgggttttctgctccatcccacccacctccctttgggcctcgatccctcgcccctcaccagtcccccttctgagagcccgtattagcagggagccggcccctactccttctggcagacccagctaaggttctaccttaggggccacgccacctccccagggaggggtccagaggcatggggacctggggtgcccctcacaggacacttccttgcaggaacagaggtgccatgcagccccgggtactccttgttgttgccctcctggcgctcctggcctctgcccgtaagcacttggtgggactgggctgggggcagggtggaggcaacttggggatcccagtcccaatgggtggtcaagcaggagcccagggctcgtccagaggccgatccaccccactcagccctgctctttcctcaggagcttcagaggccgaggatgcctcccttctcagcttcatgcagggttacatgaagcacgccaccaagaccgccaaggatgcactgagcagcgtgcaggagtcccaggtggcccagcaggccaggtacacccgctggcctccctccccatcccccctgccagctgcctccattcccacccgcccctgccctggtgagatcccaacaatggaatggaggtgctccagcctcccctgggcctgtgcctcttcagcctcctctttcctcacagggcctttgtcaggctgctgcgggagagatgacagagttgagactgcattcctcccaggtccctcctttctccccggagcagtcctagggcgtgccgttttagccctcatttccattttcctttcctttccctttctttctctttctatttctttctttctttctttctttctttctttctttctttctttctttctttctttctttctttctttcctttctttctttcctttctttctttcctttctttctttctttcctttctttctctttctttctttctttcctttttctttctttccctctcttcctttctctctttctttcttcttcttttttttttaatggagtctccctctgtcacctaggctggagtgcagtggtgccatctcggctcactgcaacctccgtctcccgggttcaacccattctcctgcctcagcctcccaagtagctgggattacaggcacgcgccaccacacccagctaatttttgtatttttagcagagatggggtttcaccatgttggccaggttggtcttgaattcctgacctcaggggatcctcctgcctcggcctcccaaagtgctgggattacaggcatgagccactgcgcctggccccattttccttttctgaaggtctggctagagcagtggtcctcagcctttttggcaccagggaccagttttgtggtggacaatttttccatgggccagcggggatggttttgggatgaagctgttccacctcagatcatcaggcattagattctcataaggagccctccacctagatccctggcatgtgcagttcacaatagggttcacactcctatgagaatgtaaggccacttgatctgacaggaggcggagctcaggcggtattgctcactcacccaccactcacttcgtgctgtgcagcccggctcctaacagtccatggaccagtacctatctatgacttgggggttggggacccctgggctaggggtttgccttgggaggccccacctgacccaattcaagcccgtgagtgcttctgctttgttctaagacctggggccagtgtgagcagaagtgtgtccttcctctcccatcctgcccctgcccatcagtactctcctctcccctactcccttctccacctcaccctgactggcattagctggcatagcagaggtgttcataaacattcttagtccccagaaccggctttggggtaggtgttattttctcactttgcagatgagaaaattgaggctcagagcgattaggtgacctgccccagatcacacaactaatcaatcctccaatgactttccaaatgagaggctgcctccctctgtcctaccctgctcagagccaccaggttgtgcaactccaggcggtgctgtttgcacagaaaacaatgacagccttgacctttcacatctccccaccctgtcactttgtgcctcaggcccaggggcataaacatctgaggtgacctggagatggcagggtttgacttgtgctggggttcctgcaaggatatctcttctcccagggtggcagctgtgggggattcctgcctgaggtctcagggctgtcgtccagtgaagttgagagggtggtgtggtcctgactggtgtcgtccagtggggacatgggtgtgggtcccatggttgcctacagaggagttctcatgccctgctctgttgcttcccctgactgatttaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgcgagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatgagtgggccgtcgcaagtgtgccatctgtgtctgggcatgggaaagggccgaggctgttctgtgggtgggcactggacagactccaggtcaggcaggcatggaggccagcgctctatccaccttctggtagctgggcagtctctgggcctcagtttcttcatctctaaggtaggaatcaccctccgtaccctgccttccttgacagctttgtgcggaaggtcaaacaggacaataagtttgctgatactttgataaactgttaggtgctgcacaacatgacttgagtgtgtgccccatgccagccactatgcctggcacttaagttgtcatcagagttgagactgtgtgtgtttactcaaaactgtggagctgacctcccctatccaggccccctagccct

SEQ ID NO: 5 - DNA, 533 bp, homo sapiens
tgctcagttcatccctagaggcagctgctccaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgcgagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatg

SEQ ID NO: 6 - DNA, 2480 bp, homo sapiens
tttgcttcccctcttcccgaagctctgacacctgccccaacaagcaatgttggaaaattatttacatagtggcgcaaactcccttactgctttggatataaatccaggcaggaggaggtagctctaaggcaagagatctgggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacaggtaagggccaccccaggctatgggagagttttgatctgaggtatgggggtggggtctaagactgcatgaacagtctcaaaaaaaaaaaaaaaagactgtatgaacagaacagtggagcatccttcatggtgtgtgtgtgtgtgtgtgtgtgtgtgtgtggtgtgtaactggagaaggggtcagtctgtttctcaatcttaaattctatacgtaagtgaggggatagatctgtgtgatctgagaaacctctcacatttgcttgtttttctggctcacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggccagctgtgggtcctgaaggtacctcccggttttttacaccgcatgggccccacgtctctgtctctggtacctcccgcttttttacactgcatggttcccacgtctctgtctctgggcctttgttcccctatatgcattgaggcctgctccaccctcctcagcgcctgagaatggaggtaaagtgtctggtctgggagctcgttaactatgctgggaaatggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgagtgagtccaagctgttttctgatagttgctttagaagttgtgactaacttctctatgacctttgaa

SEQ ID NO: 7 - DNA, 1842 bp, homo sapiens
cgatcagatcgatctaagatggcgactgtcgaaccggaaaccacccctactcctaatcccccgactacagaagaggagaaaacggaatctaatcaggaggttgctaacccagaacactatattaaacatcccctacagaacagatgggcactctggttttttaaaaatgataaaagcaaaacttggcaagcaaacctgcggctgatctccaagtttgatactgttgaagacttttgggctctgtacaaccatatccagttgtctagtaatttaatgcctggctgtgactactcactttttaaggatggtattgagcctatgtgggaagatgagaaaaacaaacggggaggacgatggctaattacattgaacaaacagcagagacgaagtgacctcgatcgcttttggctagagacacttctgtgccttattggagaatcttttgatgactacagtgatgatgtatgtggcgctgttgttaatgttagagctaaaggtgataagatagcaatatggactactgaatgtgaaaacagagaagctgttacacatatagggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcattttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttaaattttttttttttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaggcaagtctctatattatgtcctcttttgtggtgtcttccatgtgaacagcataagtttggagcactagtttgattattatgtttattacaatttttaataaattgaataggtagtatcatatatatgga

SEQ ID NO: 8 - DNA, 18001 bp, homo sapiens
gaagtcatcagcaatgcaactgttcacatggaggatactccctgcttgaggggtcagacaggcctgctgggcaacccaggaggcttggatgaccgtctaccccagtgtttttgggatggaaagttccacattctgagaaccctcagtccctgggcaacctggggtggttagtcaccacagcttgtggcttgggcccatgacagcaggtagaaatgacgtggactgccgccagccgggcacagtggctcacgcctgtaatcccagcactttgggaggctgaggcatgtggatcacttgaggtcaggagttcgaaaccagcctggtcaacacggtgaaaccccatctctgctaaaaaaaaaaaatatatatatataaattagccaggcatggtgacgtgcacctgtggtcccagctactcaggaggctgaggcacaagaatcacttgaacccgggaggtggaggttgcagtgagattgcaccagtgcactctccagcctggcaacagagcaagactctgtctcaaacaaacaaaacaaaacaaacaaaaagacgtaagatgtggaccgctggagaatgggggtgctgcctgcagtcaaaacggagtgggggtgcccagctcagggccagaatgatcctattcccggcacttctcagtgaggctctgtggctcacctaagaaaccagcctcccttgcaggcaacggcctagctggcctggtctggaggctctcttcaaatatttacatccacacccaagatacagtcttgagatttgactcgcatgattgctatgggacaagttttcatctgcagtttaaatctgtttcccaacttacattaggggtttggaattctagatcgtatttgaagtgttggtgccacacacaccttaacacctgcacgctggcaacaaaaccgtccgctctgcagcacagctggggtcacctgacctttctcctgtcccccccacttgagctcagtggctgggcagcaggggatgcatggccactggccggccaggtgcagctctcagctggggtgttcagaggacgcctgtgtcctcccctcccccatccctctgtcacccttggaggcagagaactttgcccgtcagtcccatggggaatgtcaacaggcaggggcagcactgcagagatttcatcatggtctcccaggccctcaggctcctctgccttctgcttgggcttcagggctgcctggctgcaggtgcgtccggggaggttttctccataaacttggtggaagggcagtgggcaaatccaggagccagcccgggcttcccaaaccccgcccttgctccggacacccccatccaccaggagggttttctggcggctcctgttcaatttctttccttctagaaaccagcatccaggcacaggaggggaggcccttcttggtggcccaggctttggcgggattatttttcaaagaactttaggagtgggtggtgctttcctggcccccatgggcccctgcctgtgaggtcggacaagcgcagggagtctggggcctctcagagtgcaggaagtgcgcacagggtgctcccaggctggggagcacaggtaggggacggtgcgtgggggatggcgcctggggcatgggggatggggtgtgggaaacggcatgtggggcgtaggggatggggtgtggaggatcgggggtggggatggcgtgtggggtgtgggggatgggccgtgggggggtggggcctgggaaacagcatgtggggcatggggtgtgggggtgaggtgtgggaaagtgtgtggggtgtgggggatggggcatggaaagggcgtgtggggtgcaggggatggggcatggaggtgtgggggatggggtgtgtggggtgtcggggatggggcatgtggggtgtgggggatggggcatggaaagggcgtgtggggtgcagaggatggggcatgggggggtggggatggcgagtggggctggggcctgggaatggtgagtggggcatggggatggcgagtagggggtgtggcgtgaggatggctagtggggcgtggggatggcgtgtggggatggcgagtggggggtgggctgtgagggacagtgcctgggatgtggggctgcagccctagctcacagcatggccttatgaccccggccaccttcctgccccaggcggggtcgctaaggcctcaggaggagaaacacgggacatgccgtggaagccggggcctcacagaggtgagcagggactgccactggttttgtcctggggcccagtgggggccaacatcacctccttcccctcccatggcaaagagccagcccgcggggtggctactgcagtgccccccaaggagggtgttccctgctcgagaggaagtgaccgctccagcttggccttccctgggactggggtgcaggcgattttatcttctttgctccattctgttccttccagataatcgtgtgttcttcatcaggttttcctcagttcttgagagcttttctgatgcaaatctgctttcaccccagggcggtcaccggctctgctcacaccagcctccaagggtgtgggtgtcccgggagtgtgggtgtcccgggggcgtgggtgtcccaggagtgtgggtgtcccgggggcgtgggtgtcccgggagtgtgggtgtcccgggggcgtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagtgtgggtgtcccgggggagtgggtgtcccgggagtgtgggtgtcccggaggcgagggtgtcccgggagtgtgggtgtcccgggggagtgggtgtcccgggagtgtgggtgtcccggaggcgagggtgtcccgggagtgtgggtgtcccgggggcgtgggtgtcccgggagcgtgggtgtcccgggggcgtgggtgtcccgggagtgtgggtgtcccgggggcgtgggtgtcccgggagtgtgggtgtcccgggggcgtgggtgtcccgggagtgtgggtgtcccgggagtgtgggtgttccggaggcgagggtgtcccgggagtgtgcgtgtcccgggggcgtgggtgtcccgggggcgtgggtgtcccgggggcgtgggtgttccggaggcgagggtatcccagaagtgtgagtgtcccaggggcgtgggtgtcccgggggtgtgggtgtcccgggggcgtgggtgtcccgggagtgtgggtgttccggaggtgagggtgtcccgggagtgtgggtgttccggaggcgagggtgtcccgggagtgtgggtgtcccgggggcgtgggtgtcccgggagtgtgggtgttccggaggtgagggtgtcccgggagtgtgggtgttccggaggcgagggtgtcccgggagtgtgggtgtcccaggggcgtgggtgtcccgggagtgtgggtgttccggaggcgagggtgtcccgggagtgtgggtgttccggaggcgagggtgtcccgggagtgtgggtgtcccgggggcgtgggtgtcccgggggttgtgggtgtcccgggagtgtgggtgttccggaggcgagggtgtcccgggagtgtgggtgttccggaggcgagggtgtcccgggagtgtgggtgtcccgggggtgtgggtgtcccgggggtgtgggtgtcccgggagtgtgggtgtcccgggggagtgggtgtcccgggagtgtgggtgttccggaggcgagggtgtcccaggagcgtgggtgtcccggaggcgagggtgtcccgggagcgtgggtgtcccgggggcgtgggtgtcccgggagtgtgggtgtcccgggggagtgggtgtcccgggagtgtgggtgtcccggaggcgagggtgtcccaggagtgtgggtgtcccgggggcgtgggtgtcccgggagtgtgggtgttccagaggcgagggtatcccagaagtgtgagtgtcccgggggtgtgggtgtcccgggggtcgtgggtgtcccgggagtgtgggtgttccagaggcgagggtgtcccgggagtgtgggtgtcccaggggtgtgggtgtcccgggggcgtgggtgtcccgggagtgtgggtgtcccgggggagtgggtgtcccgggagtgtgggtgttccggaggcgagggtgtcccgggagtgtgggtgttccggaggcgagggtgtcccgggagcgtgggtgtcccgggggcgtgggtgtcccgggagcgtgggtgtcccaggggtgtgggtgtcccgggggcgtgggtgtcccgggagtgtgggtgtcccgggggagtggatgtcccgggagtgtgggtgttccggaggcgagggtgtcccgggagtgtgggtgttccggaggcgagggtgtcccgggagtgtgggtgtcccgggggcgtgggtgtcccgggagtgtgggtgtcccgggggcgtgggtatcccagaagtgtgagtgtcccaggggcgtgggtgtccggggggcgtgggtgtcccgggggtgtgggtgtcccgggggtcgtgggtgtcccgggagcgtgggtgtcggggactgcagggacatgggcctcccctcccactcctgccgcccagggcacctcctgtgaggactcggagtccgtgagttcccacctccttgagcccgattctttggtgtccccgcctgcatcctcagcctccttccaaaccagaccagttctctaggggcgtcgacgtgtgaaactgattttaaagaaaacaggcagtggcctttctctcggccccacgtggcccagtagcgctcaccttccgtcccttcttccgcgctcagtaaccaatttaggccgctcctgcagaactcgggctcctgcccaccggcccacagcgtccacctgaggcctcgtcctcccagcaaaggtcgtccctccggaacgcgcctcctgcggcctctccagagcccctcccgcgcgtcctctcagccccgctcgcctcctcccggggcctccctctcccgcctgcccccaggcccgtctcccctcgcgggctgaggcaggttcgggcagcacggccgccccggggcgggggtcactctccaccaccgcgtggtgcccacagctcacggcgctcccgggtgacggtcccctcggctgtagggcgtcctgaagagcggcctgctcggagctgagcgcacggggttgcctcgccctgggcgtctctggccctcaccagccccgtcttcccatgggcaaaacggcggtcctgtttgtccacaagtaaccgtcggggttacggaggggccaggagctgcggcggggggctgtgctctcaggaccggccccaggaggatccgcgcgaggtctggagctctcaggggtcgcgggggacagaggggccccaagcggaggcggggaaggcggcagaagcccaggaccgccaagagctggcgaggaagcccggggctcgctgtcgggggagccgggcaggggccgcgcctcggaccaggacggaggcctggggaaggcggatctggccgccggagacgcggtgcgggtggagacgagggatttggatttccgcgggcggctgtacggatttccacgcgcggttcacgtgggccccagggggttgcccggcacccggggccgcgccgccttctcctcgccggcatcgacccgcagcctcacgtttacgcggcggcgcccgcagcccccttcggcccggcttccgcgcgtgcccccgagcgcgccctcgggatcagcccccggaagcagagaggccaggccgggaaggatgggcgacgggggtggctgacccgggagcacggcagggaggacacccagccaggcccgcgagcagcgccgctcccctcctccaggacgggcgggaacctgcgatgcccccgccgcgtgggccgtggggcggtctccgaggcactgggcggggcacgcggtgggcgcttcacggaactcgcatttcccagtcttcgtaacccaggaggaagcccacggcgtcctgcaccggcgccggcgcgccaacgcgttcctggaggagctgcggccgggctccctggagagggagtgcaaggaggagcagtgctccttcgaggaggcccgggagatcttcaaggacgcggagaggacggtgagcccagcctcggggcgccccgcgccgcggacactgcaggcggcggtgaaccaggccgcgtggggccgcctgcgtctctttggctgcggctgtgggcggcgaacacgcagcggcgcccgcgcggcgctttctgcgggggtcgctttccgcccggggtgactccgctttcctgggcgatgccccccacccccaggcacgcgctctccccgtgcggccgcaccgcgcatgccggttttcacatcagaaaatacgatttgcaaagcacacttagggtgtcccccttaacttcccaagggagtccccccagtccccgaagggtccagggcagcctgcgcatcgcagacgcgcgcggctcgcagaagggacgtggtgagaagctggcccacagcatgccaccagcggcacctcctcagggcacgtgtcggggagaaacaacacttagggacctgggactttctccagctcacgctcacgggtcacctcacactccaagatcacctcaaagaggacacctcacacagggcacacttcacactcacaggtcacctcacactcacaggacacctcacactcacagggcacacttcacactcacgggtcacctcacactccaagatcacctcaaagaggacacctcacacagggcacacttcacactcacaggtcacctcacactcacaggacacctcacactcacagggcacacttcacactcacgggtcacctcacactccaagatcacctcaaagaggacacctcacacagggcacacttcacactcacgggtcacctcacactcacaggacacctcacacaagacacctcacacggggcacacttcacactcacaggtcacctcacacccacaggacacctcacacagggcacacttcacactcacgggtcacctcacactcacaggacacctcacacaagacacctcacacggggcacacttcacactcacaggtcacctcacacccacaggacacctcacacagggcacacttcacactcacgggtcacctcacactcacaggacacctcacactcagggcgcacttcacactcacgggtcacctcacacccacaggacacctcacagaggtcacctcacacaggacacctcacactcagggtgcacttcaaacccacaggtcatttcacctcacactcacaggacacctcacacaagataccacacggggcacacttcacactcacaggtcacctcacactcacaggacacctcacagaggtcacctcacacggggcacacttcacactcacaggtcacctcacacccacaggacacctcacagaggtcacctcacacccacaggacacctcacacaggacacctcacagaggtcacctcacacccacaggacacctcacactcataggtcacctcagtcttacaggacaactcacactcacaggtcaccttactctcacaggacacctcacactcacaggtcaccttactctcacaggacacctcactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcacctcacactcacaggacacctcacagaggtcacctcacacccacaggacacctcacagaggtcacctcacacggggcacacttcacactcaggtcacctcacacccacaggacacctcacagaggtcacctcacacccacaggacaactcacagaggtcacctcacacaggacacctcacaaaggtcacctcacacccacaggacacctcacactcataggtcacctcagtcttacaggacaactcacactcacaggtcaccttactctcacaggacacctcacactcacaggtcaccttactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcaccttacactcatctcacactcacaggtcgccacacctcacactcacaggatgcctcacactcacagaaccacatctcatatgcacaagacacctcacactcaggacacctcatgctcaaagaagcctcacactcacaggaggtccagctgtctgaggcaaaggctaacatgaccctttccagacaaattgaggatggtcatgcctagcatttttatacacctagttttgaaagcatttctcatctgttgtattctcacagcaccccgtgagtttaagttcaggtggccaacagtttcttcagcaatcacttttttctgtggagtgcttttgctgtttgtggaatattttgcatctgctactgcaccctctccccgtatgtgtggccaccctgtcagaggtggagctgtggctcagagcctgtgtacctcgtcccaggtccacagctcagcgacagaagagtcagggttgaacctcgggtgttctgacttgggagcaggaaatgtgtggtcacccatagttccagatgtcctggggaggggccaagattagaagaaacctacctcagctccagaggaaagtctggcttcctgagcccaccccgccagacccaggtccaagtcccccaaccccagttcatggtgtgtccagtgcttaccgttgggtgctctggtgaaggtgcatctcacgaggcttgctctcttgttccttcagaagctgttctggatttcttacagtggtgagtggatgatcaccaccagtcctgcctgcaacccttctcagcttactgacaccagcccactccacagatggggaccagtgtgcctcaagtccatgccagaatgggggctcctgcaaggaccagctccagtcctatatctgcttctgcctccctgccttcgagggccggaactgtgagacgcgtaaggccccactttgggtcccatatttgcagagggccctggggagctggtggaggtggcctggccaaccgggctgcagggtgcacaacctggtggggtgtgtaggccgggcattcagggctcagccccagttggaaattggtctaggtgaccttgaaatcccttccagtctgaggtctttgacagggacccaaggttctgattatcagactcagtggccccttgggctcccggccctgggcaattctcagccctcgagatggcccagctgagagtccctgtgtccctgtcccacttccacatcccaccacgcaggaccgcttggtaaacttccccttctctactttccattacaaaggtttgaggggtttgttttttttttaaccatctgaatattaaattatcacaaagtttgaggcccccaacctcccttgggttcagtaattcactagaaggactcatagaatccactgaagtggatacactcacaggtaccgtttattacagcaaaggatgcaggcttaagtctgcagagggaccaggcacaagcttccccttgtcctctccctgtggggtcatgtggacagtccttaattctcccagaatgacgtgtgacgagacgtgggaagtactgccaacttgggaagctctacgagccccggtgtccagaggttttatcagggctcaatcacatagacccagctgaccacccgcatggctgacctcagtctcagcccctccagaggctacgccgatagtgcggcccaaggccccaccatacatcacattgtcagctagaccatccagcatggctcaaggcccaggtaaacaccaacattccctcaggcaagaccttccaagggcttagcggtcatttcccaggagccaaggcaaaggctaccctttctctggcacagcagttcatccttgaccacccaagaccacattcttacactgaatgagctctcctgtgcagcagccattttcttctctaagcagaagagagcccagcaagctggaggaggctgaagagagaggcttcctgctggtcatctgggtccagaatgcctggagatctctgctcagccctggtgcccagcagccctggtgtgcatcctgcagggcaggccttcccgccggagtcctggacttgctcagggccactccccttgcccatgtcaaccaaagtcaggctgccggttctgcttcttctgtctgagcccatgaccagtgctgggactaactgtccccaggcgggctcacggtggtacgaggccagcttggagaactgtctcagctctctggtcctctcgtcagttgggtctctgattggaaagtcccttggacacttttaccatccccattggactttcactttcccccaggctcccatcagctgctcggaagagtggtcaccctggaggccactgcccaccagccaggcaccccccaaatgcaaccgcagccagcactgccagccactggcaaggctgttcagacatgtggctcctctgatccacgccttgtcctttggatcagtccacggagcaggtggtgccaagctcaggctctgtcacccacagctcagtgccaccttccaggcagaacaccactgctgacccagggcatggccaccccgggggctggctctcgctgacccccagaagcccctctcagggtgtccccttcctgtccccagacaaggatgaccagctgatctgtgtgaacgagaacggcggctgtgagcagtactgcagtgaccacacgggcaccaagcgctcctgtcggtgccacgaggggtactctctgctggcagacggggtgtcctgcacacccacaggtgaccaggcttcatgtcccagtcccagatgacaccagtccctgtcccactacggattatcttactggacaaaagacgggtgggagtggcttcacatctactgagcactaactatgcactgaccaattgtgaggtgggatctgggcaccaagggtggcacaggccagagcgacagtgactaggatgggcaccctgggggcaatccctgaatggcctcaggccccctgccaattctaggcagaccaggggagccaagcaaggcactatctcacgtccaactcccactcgcaggacctccgccagggttcatgaatctacttcggcacagccaatgtctgtactgactgctgcccactctgcattccaaaactcgtaaaggctcctgggaaaatgggatgtttctccaaaccagcctggaacgaatgggctgcacttccaaaagcagggacaccccacacccactgtgtctcaaagaggcggacgtgcccaccctggccacacagcctgggactcagcctgccacctcctcgggcttcctttctggcccaagaccttgattgaagcagatcaaaactaagcatgggatcaaaacaacacagtttgattcatctttaggtagaatttcattcaccttctactaaagtcaaacaacacatcttctccctgaaaagtgagcagagggcggttttaagacgtaagccctctgtttcctccaaaaccagccctgaccattgtctcctcagccagccacttcttcaagggcctctcatggccgggccccaccagtcaggcccagccgaggccctgccttccaccacccctgggccctgggagctcctgctcctgggggcctcccatagcctcggcctcaaggcctctcagaggatgggtgtttctgaatctttcctagtggcacgttcatccctcacaaatctctgcatctttctgacttttgttttacacagttgaatatccatgtggaaaaatacctattctagaaaaaagaaatgccagcaaaccccaaggccgaattgtggggggcaaggtgtgccccaaaggggagtgtccatggcaggtaaggcttcccctggcttcaggattccaagccctgagggtcttgaagccttttgaatgtgaacaacagctctggaagggaaaatgggcaggtcagccccaagcccaccaggctccaagtcagcacacctagcacctccagctcgcggcacccccatgcttttagtggggcaaggaaggagaaaagaaaacgacactcactgagggtctaccctgtgcagagaaccctgcgagatgccccatccgagttgtcacgtcgtcctcacggttactctttgaggtgggatctttgcctgatctttgcaaaatcaggagcattggatcaaagctatgtgaagatcctgtgaggtgaacagtgaaatctcacagcgacatttgtattcttgggccgtgcccaagagcacgtctcggctagagaggggcacagcctcccagagccaggtctgagcagctttgcctgggagggatctgcaaagaccccaggatttcagaaagaaattgtgcaatgccagaggttccttggcatgcccgggagggcgagtcatcagagaaacaatgacagcaatgtgacttccacacctcctgtccccccgcccaggtcctgttgttggtgaatggagctcagttgtgtggggggaccctgatcaacaccatctgggtggtctccgcggcccactgtttcgacaaaatcaagaactggaggaacctgatcgcggtgctgggtgggtaccactctcccctgtccgaccgcggtgctgggtgggtgccactcttccctgtccgaccgcggtgctgggtgggtgccactctcccctgtccgaccgcggtgctgggtgggtgccactctcccctgtccgaccgcggtgctgggtgggtgccactctccgctgtccgaccgcggtgctgggtgggtaccactctcccctgtctgaccgcagctctcaagtgtctcaggggctgtggctctgggcttcgtgctgtcacttccacagacagacagacatccccaaaaggggagcaaccatgctgggcacgactgctgtggccaccgtgctctcagccactttcccatgcccaaataaaacgataaaagactgggggcttctgcccatcctgcctcacttgaccaagagcccagaagaggatgcgacacccagggcctcatgggaccaccggctggcaggggttctgctcactgggtttatgggtgagacgagcactcccaggagggccactgggccgggaagaactgtggagaatcggggcacgccctgtcctcccagctgccagggcacagcatcccttccccacctcaacacccagaccccagattcaccccagttcacttgtccccacacgagccacaggctgccacctggggcaggctggccccaccttggggttagatgcaggtccccttgccccagaaggagactgcagcccctgcagacctagaaatggccacagcccatccccatgcaccagggggtgaggtggcaggtggtggaaagggcctgaggggggcttcttccttccaggcgagcacgacctcagcgagcacgacggggatgagcagagccggcgggtggcgcaggtcatcatccccagcacgtacgtcccgggcaccaccaaccacgacatcgcgctgctccgcctgcaccagcccgtggtcctcactgaccatgtggtgcccctctgcctgcccgaacggacgttctctgagaggacgctggccttcgtgcgcttctcattggtcagcggctggggccagctgctggaccgtggcgccacggccctggagctcatggtcctcaacgtgccccggctgatgacccaggactgcctgcagcagtcacggaaggtgggagactccccaaatatcacggagtacatgttctgtgccggctactcggatggcagcaaggactcctgcaagggggacagtggaggcccacatgccacccactaccggggcacgtggtacctgacgggcatcgtcagctggggccagggctgcgcaaccgtgggccactttggggtgtacaccagggtctcccagtacatcgagtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacagagacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacggatgcacagagatatgcacacaccgatgtgcgcacacacagatatgcacacacatggatgagcacacacacaccaatgcgcacacacaccgatgtacacacacagatgcacacacagatgcacacacaccgatgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcgtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaaaagctgtttgatagatgtttgaggctgtagctcccaggatcctgtggaattggatgttctctccctgccacagcccttgtcaatgatatttcacagagaccctgggagcacctgctcaagagtcagggacacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcagggccgtcctgggcaccactggcactcacagcagcaaggtgggcaccattggcactcacagcagcaaggcaggcaccagcaacccacctcgggggcactcaggcatcatctacttcagagcagacagggtctatgaactacagccgtgggctgcttccaaggcaccctgctcttgtaaataaagttttatgggaacacacccatattagtgtccatggagtggccgtggcagagacgtccagccggacagaccagctgacccgccaagcccagcatggttagtgtcaggacctctgctgaagatgcttgctgaccctggccagaccccggttcctaatgccccctaaacgggacgggagccagtggcgggccctgatccaggtcagagctggctctgctttctcttttgtccgagtgaccatgcctcagtttcctcatgtgtaaaacaggagcccaccgtgatgcttatggtgggatgagatcagcatggatggaacaaggccctggaagggcccatgccatggtcatcgacagcaaagccactctgcagacagatgcttcagtgaattggtagaaaattctgcaaccagaatgcccggggctcctgagggcctaagcccagcccagggttctggaagccactctgacttcttgggagtggaagttggcaggactcttcctgggaagaagcggagggtggggatgagaggacagttcaggagcccacccagacccacaggaggaaactaggggagtcatgcggggtcctggtggagcgccagcctcccttcctgccaatgggaaatgcaggcgcccacctcatggtgctgccggaggagggggcccgggactccccagaggcttcgctgaagggcctgggcgcccccaaaggctacatgtttcatatgggacgtgccacctgccacggctcagctccagctttctgtgagtggcgagatagaatacggggaggccactggccatgggcctgggacagggtgggatgaggcggcaggcttgggccaccaaagccagcatcgccacccagcattgatgacaaagactgcgtgtctgccatgagcatcctgctgttggtgcacacaccgcattggtctctccatacaaacatgcctagaggcgatgtcagagggtggagaccaggagaggcaggagtcagacatctggtgccaccaggaaggcccttctcagaggaccaggctgtgcgtggtgcccgccgtgggaggccagcctggcgttggcatccagcatcatcagtttgtgcagtcgggtggggctcagtgagtgcctcctgtgtgccaggcacaatgacgcacaatgtgtgcacaccaggctcatgtgcaggtggctgcgagacagggcgacccatcaaggcagatgcaccatgaggcagtggccagtgctgtgggtgttaggggcattgctccccggccactacggcatagcaggcagtgatcgccacactggccaagctttagaccatttattccagagaccccagaggcaaaaagcccggctgcacctcccagtgactcccacagccattgagcagagacactcaggaccttgtgatgggaggtttctgcactggagaacgagcccagaagccctctcagcctcggaacagtgtggccagtggtgggcaggtcaggaggggcttcagacacagcctgtccctccagatggtcacgggaaggtcactccccacagaagtacgttttggggccatgcgggcacagaaggtttgggggtgggtggggcaggtgccagcctggcctgtgggaggccatggtgcagatgccaagccccccccgtgacatgagaccacctgataccacccagagagtggctgtgagcggaagggcccgcccagaaacaagcagggccttggggcagaagtcctgggctcagatcccacgctcactgccagcggcctcggctcaggcttctgcgctctctaaacttagttttctcttctggaaaaatgatggggaaaatgatatttgtatgtgaggactgagagttaaatgtaaacatctggaaactacaaaatgagcacgaaatgatgtttttattcttagaacagaaagtccccacacccgcggccctggtgactgatgaggatgaggttctgcggggcctctctggccgcccagctctgcctggggaaggtggggcca

SEQ ID NO: 9 - DNA, 3278 bp, homo sapiens
aggcacacaggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtg

SEQ ID NO: 10 - DNA, 162001 bp, homo sapiens
aggctgttgcgtatgtgagtctggagttcggaagagacatccaagttgctgacataaatttcggtcttcagtgtagaaatttgatttaaagccattgggttaaacaaaccaaccaaggtaagagtatttgcaggtaagagaagagacccaaggacttagccctaaggcactccagcattatgatgtaggggagatgaggaaccagcaaaggaggctgaatggaaacagagaaggaatggcgagttctgtgcaagagacaggaagaaagagaatgcaaaatggtcaaacaataaataattaagttgaattagatggtaaagaaataaatgcaaggaaatgcaaggccatagtcactgggcagacagagtaaaagaacatgatgaatcaggtgagattaatcacccctcctggaactatcagaaaaagatactcactgacagtgaggcagtcatgttagtccccaagttgatgactaatggaaactaaggtcacagtgcacattaatttcttttgaagcaaaggataaaaacaaacaaaatataaaagattaagatgtaaacgttagtgtacactaattcagagaagaattaaatgatttttaaaacttcaagaaggaggacagcattctaaatgcattgttctaaaacgatagtaagatgggataaatagtcacactagggtgatgattttggatgtgttaaatttgtcactttgagaccagatatgctccatttcacttcatgccagcttttaagaacatatatcatagaaaaagagaaaagaaacagttgaatcaaagtgaagagaaatattgtgaagcaaataaatccagggaaaaattaataaaaccctattcccaccctaaaaaaaagaaactaaaagaagtgcaaatataaagttcaataggagtcattagagattgtaaattgggctctgagcttcctaccaacaaaagcacaaaggaaaatatgatcactggtattaaaaaaaaacacctatggtttccaaaagattaaaacaaaccagcagttttatagaagctaacactaaaatctaaaggaactacgttctatggagccacttaatatggataaacactttgacaatattctttcaacaactacagtaacaagtttcttagagtccatttctttttacatccataatgaattgtaaatcttttctacttcttaagtaaaacatcaccacttaattctggtaacttttccatattaactttttagaacaattgcaaacgtaccataaatgattgttgtcacagtggtaactatttgaccctgactgttattttgtatatagcagcttttaaaataaaaaggcaacaagtttctaggcgtaatttccacagatcttttatgtaaaacaatgacatcctttgcaacttctgccatttaatctatctcaagcaagctctctggaaacaaatctatttgaaagattctattgtaattagaaatcagggtaactgaatgcactagatgaaaaccttctgactggggccaatgaagtcaataaagtcaaaactgctgtgaatgctcaactgtctgcagatcagatgtcttgggatggaatccgttctcgaggccaccatcattaatatcaatttggccatgtaatacaagcctcacttgttccactgttacaaatgtgcttaaaactgagctcatttacaatccaaatacatatgtaggatggtaaccaaggcatcacactaatttaggtattatgttttagggggaacaaaaggtatgttaatattttattcatctccaaattaactataaattgtgcattcttgcatagatcctccttgggaatgagaaattaggaaaatccagttgttaaaatgaatgcctaaaatcaaaataaaatttgtttttctggcacctgcttgatgacacagactaataaccaatgacaaaattgcccttgaacccaagttttcatttcctcctattgtgtggtcaggttatgtaagggtttgctttcaccccattcaaaaggtacctcttcctcttctcttgctccctctcgccctcattcttgtgcctatgcagacatttgagtagaggcgaatcactttcacttctgctggggaaattgcaacacgcttctttaaatggcagagagaaggagaaaacttagatcttctgataccaaatcactggaccttagaaggtcagaaatctttcaagccctgcaggaccgtaaaatgcgcatgtgtccaacggaagcactggggcatgagtggggaaggaatagaaacagaaagagggtaagagaagaaaaaagggaaagtggtgaaggcagggaggaaaattgcttagtgtgaatatgcacgcattcatttagttttcaaatccttgttgagcatgataaaattcccagcatcagacctcacatgttggtttccattaggatctgcctgggggaatatctgctgaatcagtggctctgagctgaactaggaaattcaccataattaggagagtcactgtatttctctccaaaaaaaaaaaagttatacccgagagacaggatcttctgatctgaaattttcttcacttctgaaattctctggtttgtgctcatcgttggtagctatttgttcatcaagagttgtgtagctggcttcttctgaaaaaaggaatctgcgtcatatctaagtcagatttcattctggtgctctcagagcagttagcccaggaaaggggccagcttctgtgacgactgctgcagaggcaggtgcagtttgtgtgccacagatattaactttgataagcacttaatgagtgccttctctgtgcgagaatggggaggaacaaaatgcagctcctaccctcctcgggctttagttgtaccttaataacaggaattttcatctgcctggctcctttcctcaaagaacaaagaagactttgcttcattaaagtgtctgagaaggaaggtaggttatatttttattcccattctatagctgggtaaagtgagttctaacaaagttacttgttaaaggtcactcagaggtcagagcatcagaaaaaaagacaatcacaaggctgatgttgtgtgctggatagtttaaactgaacaggaagaaaacatttttgtgggctttatctaaaaagaaatagtttgctctgagtttctcagtttcatttattcagcaagtatgtgccaagtgctattgtaggcaatgaagatacagcagggaacaaaacaaaactgacatggagcttccaactagaaaggagaacgagacaacgcgttttaaaatatatataatgtgttaggtaaaaagtgctataaggagagctaaaacacaatgagaggctagaagagtgatagtggcggaggggcttctctgaggagatgacatttgatcaggggtctgaataaagtaaagaggccagttatgtgaatatctggaagactcaaggggcagggcggaaatagccagtagaaaggccctgaggtaggaaggtgtgtggcaagtttgaggaaaaggaaagacagtctgactggagcaaagagaactggagctgaggccatcaaggcagccaggagccaggtgcagactgggctttgactctgcctgcagggaggaactgctgaaggttccaagcaaaggaccgccctgacctgccttaggtttgaacaggatccctctggctggtgtgtgaagaattaactgtagatgggcaagtgtggaaggaaggagagcagtcaggaagctgccataaccatctacatgagagaggtaaggcctcagatggaggggagcagtggaatggtggaaagtgtttattttgaatgttaagcctgcaggagttgctggaggattggacatgggggatgagaaaaagagagaggcttacagatcaggtaatttagctgatcttaagccccttacagcttaatattattccaaggtgccaataacagccaaggtaaacaaccttgtcttggacattctgcctttatttgcccacacaagatgaaattaaatatatatatatatatataatttaaataaataaattatatatatatataatttaaataaataaattatatatatatatatttagtgctgtttccatcagctactagctgagacacttgggcaaatgagggtgatctccagtcctcagtatccttgctgttaatgagagatggtcatttcttctctgcctagctcaaaagaatatgttaaataaaactctgtgaactttaggcagcacaggcttagggcttcttagtaacatcatcagcaccatcagagttaacttcatgagtcagttgagttgcctttggggtatatcattaacagattccaggaagctcccctgcccaaaagcctcccaccaatggcctgccttgttgaaagaattacacaattagcccaattcctttccattaaggcattgtggactccaaacatcctcctttaaaatggaaactaaatcgagctactgtcagtcatttgtccttttaggtgacgttatatatcagatcacttttctgccattagagctagttgaagtttgaatagggaaaaggaacgaatgaacgtggggcagagaacgcaatagtcggtgggttactcagtaggctgtggacagatggagaggatcccggtgggaggagcctctaaagataaactttctatgggaaaatgttgacagatttacctgagtcatggtttttcttacacctcataaaaatgaaggcttccaagggcagctccttgaaatagctgtaacaagtagccacagaagttgagttgcttaaagaaaaacattgaattcatggggaaccgtacgctttaatagcccctttggcttactttgtttaaacaaactcatcccgagcatctcacacttcaccaattttgagtgtccctgctttacctcagccttttaaagagtgtctttcccctaaatatttctggaaatgcctaagggtgctgacgtgcagccagaaatagttcacttctgtccccactatggcaggaatccatggaccaaggctctgatgtttccacaaagatgcccctcaggactagaaatctgtccccatccccgttgccaccacagtcaccatcacctggaaatcctgcaggaccaatgtttgtgaatttggaatatatgctagatgccttactaccttgttatgaccttatttctttatagcacttttaacctagcgcattacatattttaaatgtataattcagcgatccagatcactggtccagtgtcacctcccactcagcaaagtgagatgaacacacttggtgctacattcagctaggctggcactgtagatgcacccagtcccaggtattctagtggctcatgacagggcttcctcactggagacatgctgagccaagcaaggcagtttttaccaccaaccctgatagtcgtacacatattctgctcctccacccccaccaaggttgaaactccgctcctgtcagctttgcagctaccaccaccccctcagggagagtcatctctgttcccaaacccatataaatgtcattcaaagccagaggatgtaattgctgtagtaattgttatagtccactcatccaggggccccactgcaaagctgattaaaccatagtgttactaccttttacagagttattattcttccaaatcaacccactgcacctttctccaaggctacaaaagtgcccctagggtggctgtgtacaggcaagttttgatgtcagctgggaaactacctataacccccactctctgctaacaccaacttttctttttctattttattttattttattttactttaagttctgggatacatgtgcagaacgtgccggtttgttacacaggtatgcatgtgccatggtggcttgctgcacctatcaacccaccacctaggttttaagcctcgcatgcattaggtatttgtcctgatgctctccctccccttaccccccaccccctgacaggcccgggtatgtgatgttcccctccctgtgtccacatgttctcattgttcaactcccacttatgagtgagaacatgcataacaccaatttttcttattggaattgtagtgccagtttagttcttcagtggaagcacttgttcttctctataatctgttctccatctgggaacaccctactttctcagacataggtttgcagtgcattggtgggcaggatttcagtcctttctctgaaagttcctaagccctattgaaaaatgaatgcactggggaagggtgtggcccatctctctccccagaagctcctgagccacatttcttacccagtcccggaaccctggtatcctaaaccatgtctgaacctgtacccctgtggccccagaaagggaccaaacagtacatcccatgaaaccacaaagagatcataaccttctcctctctcctcccacatctctacataaacaacatttatatagatgactgaattcaagatacgtttatttggtactgatggtcaactggaagttcctaagcagaattacttataatgtgggactgtgtttttagtggttgcagtgaaggctcaacacccctaaacacggtgggaacttgctgaggaggcaggctgtgaagggcagggtattagcatctttccttaaaataacatgtgtcttagtgtgctcaggatgctacagtaaaaataccatagatttggtggcttaaacaacaaacatttatttctcacagtctggaggctgtgaagtccaagatcaaggcactgacagatccagtgtctggtaaaggcctgcatcctagttcatagcccgctgtcttctcactgtcctcaagaggctgaaagggtgagagagctcttccgagactctttcataagggcactaatcccattcatagggctccaccttcatgacctaattacttacaaaggccctacctcctaataccatcatattgggggttaggatttcaacgtatgaattttggggagacacaaacattcagtctatataacaacacgtaccgtgaaactttcctactcataaaagtaatatatcttcactggagaaagtaaaaaagtacagaaaaatatgtagaagaaaatctaccatcatctcacatccagagatatccatggtaaatattttaatacaattcctgtgaagttattcagtacacattaatagagtttgaaaacataatctaatataaaagcatgaaattcataaagatattttaaaataaagttaatatgtatgtgtgtatatgtatttttatatatacacaaacatatatgcttattatttttattgtgagcattcccccatattattagaaaaccatgattttttgttctttttctttttcttttcttttcttttttttttttggagatggagtctcactctctcacccaggctggagtgcagtggtgcaatcttggcttactgcaacctccacctcccaggctcaagcaattctcctgcctcagcctcccgagtaacagggattacaggcccctgccaccatgcccatctaatttttttgtatttttagtagagatggggtttcaccatgttggccaggctggtcttgaactcctgacctcaggtgatctgcccacctcggcctcccaaagtgctggaattacaggcataagccaccgcaccagaccaaaaaccatgatttttgatggcatcatcttatggatgcaatataattaatttaaccattcttctactagttaatattaaggtcatttccaacttttattgttgttacattgcctctcattttctttataaatatttggctctttttattttggatatgttgtagctaaaatgccatccagatagtttattctgatttagtgcccaccaggttctaggtgcatgactgccatagcagagatagttgcatacagttcaagtttagattttgtttgtgagcgggagaatccaaagaccaagttcctaatattcttttgcctgaaaaatggctacataaccttgccaaatctcttaacattttcatgcctttgtttctaatatggaaaatgaagatactcaccaatttgtaactgtaaactactacacaagaatgaggtattcatttaaccatatggtgagattttgtagttaaaattaattaattgtgctcagtggtcagactactggctttaaatcctggatccattattcattacttcctattgtgtaacctgggcaagttacttaacttctcttctccttagtttcctcatctataaaatgaataacagaagcacttaccataagtgaggatgagataagatggtggtatatgtgagtggtacacatctgttactattattatcattgttatttattattaagcagtgaatttagactcaatgtgaaatggtttagaagtcatcagcttcccgtttcatgttcttaaagcactggtgataagagtatgcctgtatcatgcagttataactttaatcaaaatatgaaagtaactttaatcaaaatgccaagtcaaattagcaaagtcagcccttttcaaaatgtgtgccctaaagtaataaggtctgcagggtgtgccccagggacctttggtggggagtgggtggtagtcagaatggcgaaaacagtggggatttttagggcccccactcacattgctttgcttttatagcaaaaattgttggctgatgaacaaaatcatttccttttcttggactcacagctagacctaacttcccaagtcctgtacagttaaatgttaccatacaattacagtggagccatatgtgtctgtctcaaccacccaagcctgccattgcagtgtgaaagcagccataggcaatacttaaacaaagggatgtgctgtgttccaataaaatgttaccaaactttcctatagtttgccagcccctgaactagagcatggtaaggcaagagagaattgtagaacgtggttggaaaggcagaaggagtcagggaggaaagaccttgtggaactctagcacaaagtttggattttatcctaaaagcagaagggaagcctttgaagggttttagaaaagggtatgacctgaattacagaagctcagtcctcagcagatcagtatttcaacattcactcaccatgtgaaccattgatcccattttgttacttcctctgtagaatctcctcttaaggaaattgaaagcaagctcctgaatgagatggcattttcagggaaagaccaggaggcagaccccaaggggcttcacaagatggcatttttgtggccttggtggatttgccatgaccttggcttggcaggatcagaaacctgaatctattcgcctgtaagtcctcttttcttgtaagtcctataagacttacactaagttcaggtgattaacatattaagtcaaaaagcccattttagtaatttttaatgaaaaacataattgccacatgtgagaagcccattctattttcatagacatacttatattagaataacaatgaccataatggttagcatttattaacaataacattgtgccaggcacagtgtcaagcattttccatgatgacctcacaagtctatcggtaggaattgtggttaaaaccctcttatagataaagtcagaggttctaaacttataagatcacaatgctagtgagtggtagagatgagatttgaacccacacagtgtaaaccagagtgtggatacctagccactacaacatagtgtctcataggagacatgttcagaaggttgctagtggacattgaatccatgggggaaaagaaggcagaaaaatctgattttaatgttatcaggttaatggggcctgatgcagccatcttgcagaagaacggtattgctagcaggtcctccatgtttgtttacaacactggctacggccttcccactaggatgggaattcccaaatcctataatttcctagatggtgctggaagaggcactgctgaggtttgttttgccaactatctttcccctcttcttcttgccttatttgtcattctatccattaaggtgacttttcatccattttatatgaatttcataattaacctctcagggtaattcccccagcccaccctactatcagggcagtccccaatatgactaatcattcccacatactaagaccacagactgcttcagaatctgtatttatattttcactattaaaaaactatgctatcgtttcctgaaatctctatgaaaaaaaaatactaagctatatctggagtgaaatggtcagtaagaacacagtttgtcacacaaaataatgaaaatgctatttcttacttatagtgcagactggggttcttcctctagaattagaaatattaggcttgctaagatgtgatggggagttcattggggctagtgttttagcttttgaactcttcaaaaggaacagaaatgaagaaaaagacctgctttaataaacaaggttaagtctgtatgatttatggacttatgagcaaatctgacatccactcacatgggtggtcctcccaagggataaacttcgtaaaagcacatttaagaaaaagggagcagatactgttggtgccctcttcaccaggagacacactgaaaggctgcagtagcacatcagagcctcacaggtcagcatcagccaaacagctgttctgtgcatcacaagaattcgtacatatttcaaaatgactaatttgtacctatgagacaggatttgacccactaatttttgtaccgtaacgttttaataaaaattgttttttcaaagcgaagctttgctgagcagatgaattatcatgtgggagtttaaaaattagtcaaaggagtcttgacaactaagtcctttaagcttggccttcccttggcctctgcctactcctgatcataatctgaataaactttaacttttcgactagaatgcaaaacacgtgtttttgtaaaacgaatattaatggcataactcgtgctttattattttagctgatttgtatcaatgtatcaacattccaaagaaaatagggagcatatgttggttaataatttttgttatgactattgacatgtaattcacatgacataaactttaccattttaaaaagtacaattcagtgagtttgagtatgttcttaattttgtacaaccatccccgctatcaaatttcaaagcatatccatcacaccaacaataaactctggttctattagtagtcactcccaattcccttttccctagccccctggcgaccactaattaattatttctctgtctctatggatttgcctaccatgaacattgcatataaatggaatcacacaatatgtagtcttttgtgtctggcaccttccactcaacatactgtattaaaggtttctccatgttatagcatgcatcgatccacacttcatttcctgttatggctgaataacattttgtcctctgaatctaccatatttgtttatccactcatgagctgatcacttaggctgttgccacttattagctattatgaataatgttgttatgaacgttcatgtacaagtttttgggcagacatgttatttctcctgggtaaattcctaggagttgaattgctgggtcatatagtaactctatgtttacctttttgagaaaactgccaatatgttttccacagtgtctgaaccattttataatttcgctggcaatgtatgagagttccactttctccacatcttcaccaacatttattttcctttttttaaaaaacaattattgctgtcctagtgggtatgaagtgatatctcctgtattttcaatttgcatttctgtaatgaataatgatattgtgcatcttttatgtgcttattggctagttgcacatcttctttagagaactatcaggtcatttgcctttttttgaaatgttggttgtctttttattgttgaaatataaaagttctttatatattctagatctagacctttactggatatatgacttgcaaattctaccatttctgtacgttgtctacaatttcaaccattctgtgggttgtctttttattttcttcacaacgtcttttgaagcagaatagtttttcattgtgatgaagtccagtttgactatttttttcttgtgcttttggtattgtaactaacaaaccattgactaatccgagattctgatgtacatacatgctttcttctaagttttataattttagcttttacatttaagtttttaatccattttgagttaattttttaaatattcttttgcatgtagctatccagttgtcccaatgctatttgttgaataggtgattctttcctcattgaatggtcttggtattcttgtaaaaaatcagttgactgtaggcatatgggtttctggactctcaattctacccgactgatctgaatgcctatcctcatgccagtactacactgtcttgattactgcagctttgtagtatgtaagtagtagtacgttttgtgagtcctcgaactttgcctttttttatagattgttttgctattttgagttaagtatttttttaaaacatcaagttaaaaatgaagctgccactctctaaaggaggacaatttcagaaaggcactgagacctgtgcttggtatgtagtaggtgcttttgaaaatgtttgttgcatggaatggattgatttcatctctattctaacactcaatgccatgttcatttcccctttggagcctttcatctctcccttctcttttctaagaaaatcagtaactctctcattcatacattgtacacatacatatctttatttgtttatgtgtctattttccactaattagactataatgccatataaggctagaattacatctaattcattgctgggtcccaaagccatgcttaagaccataagtatataggggttttttttcttttaaaaagtttttatttttaattattatggatacataagagttacagatatgtaaagggtacatgtgacattttgatacaagcatacaccatataatgatcaaatcagggtaactgggatatccgtcacctcaagcatttgtaatgtatttgtgttagaagcattgcaattccactcttagttattttgaaatatacaataaatttttgttaactgtagtcaccctgttgtctactgaacactagatcttattcctcatatctgactgcattttcgtatccattaaacacccctcttttttattttttattttatttattattattatactataagttttagggtacatgtgcacaatgtgcaggttagttacatatgtatacatgtgccatggtggtgcgctgcacccattaactcgtcatctagcattaggtatatctcccaatgctatccctcccccctccccacaccccacaacagtccccagagtgtgatgttccccttcctgtgtccatgtgttctcattgttcaattcccacctacgagtgagaatatgcggttaaacaccccctctttatcccccctccccactacccttcccagaccctagtaaccatcattctattctttctctctctgagttcccacatatgagcaagaaatgtgatatttgtctttctgtgcctggcttatttctcttgcataatgtcctccagttccatccatgttgatgaaagagacataatttcattcttttttatggctgaataacatttcattgtgtatatgtacaacattttctttattcatctgttggtggacacttaggttgattccataccttggctattgtgaatagtgctgcggtaaacatgggagtgcagatatctcttcgatatactgattttctttcttttgggtatatgtccagcagtgggattgctgggtaatatggtagctctattttgttgttgttgttgtttttaggaaccttcatactgttctccatagtggctgtactaatttacgttcccaccaacagtgtatgagggttcccctttctccacacttttgagagcatccgtaattccctgtctttttgatagaagcaattttcactgggatgagatgatatctcattgtagtttagacttatatttctctgatgattaaggatgttgagtatttttggccattcgtatgtcatctattcagatcttttgaccatttttaaatcaaattattttttcctattgagttgtttacacaacttatatattctgtttattaatcccttatcagataggtagcttccagatattttattccattctgtgagttgtctcttcactttgttgatggtttcctttgctgtgcagaagccttttagcttgaggtgatctcatttgtccacttttgcactggttgactgtgcttttgatgtcttattcaaaaaatatttggccagaccaatgtcatctcttgccatatacaaaaatcaaatcaaattggattaaaaacctaaatcgaaggcctgcaagtatgaaaccactagaataaaacaatatatatgtgttggagggagagaagaaagtaatgaagaaagaaaggccaggtgagaaagtaagagagaagggaaaatgaacaagaaagacaaaagtcattccaggcactgttttaaggggcatctcatttattcttacaaccttatgagataagcactcttactttcagtttgttcaggatgctataacagaatcccatagactgcgtgggttataaacaatagaaatttatttctcttagttctagtgactgggaagtccatgatcaaggcactgacagaactgttatctggtgaggacctgcttcctggtttacaaatggacagccatcttctcttcttgctttgtcctcacatggtgggaaggggtaaagaagctccctgaggcctcttttatatgggcactaatcccattcatgagggctctgccctcatgaccaaatcacctcccaaaggttccacctcctaatgccatcaccatggggttaggatttcaacaggaatttggaaaggacacagacattcagaacatagcacccccattttacagataagaacagtgagaaacagagagttaaataattttctcaaggtcatacaacgaacccgtagcctaggcagcctggctctttggtcatgttcttaaatactatgccatactgtctctcaaataaacactaaaatcaagatacttgggatgatcgttgggaggcagagcccagatatctatactttaaacaaattcccaaatgatctgatgggcaactcagatgaaaatcaatgcttcaagaaatagccaaataaaactctatggaaggtaaagatggggagagcttggtgagatgtcatacttgggaggaaaagccagggaaagtaagagaaaactgggtattagtaaagatcatggagaagggaaaacacaagatattgctaggctaaaaaagaggcagacctgatgaagcagtgaacaccacttcagccactccctaccttggccccagctggccctggctgtgactgtgttccatactctgcaatgacatgtaacttccaccacgtccatatcatacctaaagcctacttcagtgtgtccacaaaagcaagtaagaataaaaagtaagagaaacaactcacatttatttgctgcttattatgtgccaggctatgtccttttttttttgagatagagtctcactctgtcacccaggctggagtgcagtggtgtgagcttggctcactgcaacttctgcctcctggggtcaagtgattctcctgcctcagcctcccaagtggctgaaattacaggcacgtttagtagagatggggttttgctatgttggccaggctgatcttcaattccagacctcaagtgatgtgcccacctcagcctcacaaagtgctgggattacaggtgtgagcctccacacccatgtgccaggctatgttttaagtgctctacccatgagaactcacttagtcctcataacaatcctgtgaggtaggtactattgtttccccccattttacagggaaggactctgaagcacacagaggttaaggagtttatcaaggtcactgtagctaacaagcagcagaaccagattcaaacccggagcccacactcttaatcactatgttgcttctagaagaaagaaaataagggatgaaggatagtaaaaacatgcaagcccttctgagccccctgttgttggccccactttggcaggagtgttaggaagactatgggaactcaaaggtgacacttagcactctcctccagaggctacaggagccatcattggtagctagccatttgtatcccccgtgatggtggagaaaagcccacactgttgcaagtttccagaattttctctgctctggaaaagactcccaaactagggttaatcaagtatcttttttggtgaatttcattaaaattaccacataaaaaaagaagaatttgtcctgaattatacatataggagaaaaatgataaaataaaataatttccattatctttgtagcaaaaaaagttggaatgattccaccaggttctctgaaggactttgttttcaaaggagatgttaaaatgtgtaaaatatccaaaggatacacttttgcagctgaatttaggatcttaagaaacatggttttaccgtgtttcccaatgattgttgaaaagaagcagtgactgggttacatctagggcagggtttctcagcctcggcactattgacattttgggccgggtaattctttgttgtggggggctgtgctatgcattgcaggatgtttagcaggatccctggcttctacccactagatgccaataagattctccctttccatctgtgacaaccaaaaatgtctccaggaatttccaaatatcccctagggccaaaatcacccagttgaaaactagtgttctagggaaaaccattataattaatagcatgtctatgatctcccctgttgcgggaagtcagggaccccaaacggagggaccagctgaagccatggcagaagaacgtggattgtgaagatttcatggacatttattagttccccaaattaatacttctataatttcctatgcctgtcttcactgcaatctctaaacacaaattgtgaagatttcatggacacttatcacttccccaatcaatacccttgtgatttcctatacctgtctttactttaatctcttaatcctgtcatctcctaaactgaggaggatgtatgttgcctcaggaccctgtgataattgtgttaactgcacaaattgtagagcatgtgtgtttgaacaatatgaaatctgggcaccttgaaaaaagaacaggataacagcaattgttcaggtaataagagagataaccttaaactctgaccgccggtgagccagggggaacagagccatatttctcttctttcaaaagcaaatgggagaaatattgctgaattctttttctcagcaaggaacatccctgagaaagagaatatgcccctgagggtgggtctctgaaatggcccccttgggtgtggctgtcttctatggttgaaactgtagggatgaaataaaccccagtctcccatagcgctcccaggcttattaggaagaggaaattcctgcctaatatattttggtcagaccagttgctctcaaaccctgtctcctgataagatgttatcaaagacaatggtgcccaaaactttgttagcaattttaatttcgcccccgtcctgtggtcctgtgatttcgccctgcctccatttgccttgtgatattctattaccttgtgaagcgcgtgatctctgtgacccacacctattcgtacattccctccccttttgaaagtccctaataaaaacttgctggttttgcggcttgtggggcatcacggaacctaccaacatgtgatgtctcccccagacgcccagctttaaaatttctctcttttgaactctgtccctttatttctcaaactggctgacgcttagggaaaatagaaaagaacctatgtgactatcggggcaggttccccgatactccccaaagtattgcatggaatgccacatttcttttatcatagtgcttcaaataagtatttcagtgtgttactgaaaatatttataaacaaaatatatttgatagcagggtatgaatatgcccgtgtccttggaagagaaagaggggacaagagaacaggtataacagcatgttgttggtgaaaataaattggtagtaatatagattgaatatcccttatccaaaatgcttccgacaggaagggttttggatttcagatattttcagattttgaaatatttgcagaatacatacaggtagagcatccctaatccaaaaatccaaaatctgaaatgttccaatgagcatttcctttgagcatcatgatagcactcaaaaagctttggattttggagcatttccgatttcagaatttgggattagggatatttgacctatagtaatgccaaatactgcactaaaattagcaaatgtaatctcattgaattgtgacaacagccttaagaggaaacccgatcattatgcctacttagtagatgaggaaacagaggtaactaggtcaaggtcacacaacttggagtgtcagagtctggattctttctagttctgccctcgtccaagccagttctgttaacactattcttcctttcagcataatctgtgtcatcactggagcttatgtctacctgcctgccacccagcaccaactgtttaccctttaagtctcattctgcctcctccaggagccttccctgacccctgccttcaccttctgacctgtgccccttcacaccctgtgccctcttaactgggaaagccctgagggcaggggccataccttatttacctctatctccagctcactgcacagaggcattcagcagatgaccagtaaatatgggctgtctagtaaaaactttgcagttagagataatgaaagaaacataattacttctgtgtgggttgagaaagaagggaagggaaagtccagatacttaagcagaaaaaggcaaacagtccaaaaggggaaaagtaacttgcccaaatcatgcagttgagggcaggaagaaagggggacaaagccaaaaccaaaacccagtcccttgtcccagcccagtgctttgtctgctacgttacacaaactgtgattgtgaaattaaagggtttttgatggcactgatataagtaaataaatggctttatgagttaacacatgacaagcaataaactcataaaaggtaaatattgacaactgaagattatatatcactatgtttagtgtgtggagaacccaactaggaattaggaaagcttgcacattcagtctggtttcttggcaaatcaatgagacttcaaacaaatcattttatttctctgtgcttctgtttcttttggctgtagtattttgctggttaaagagcacgtgatcaatgtctatgcttttaaatgtctgtctttatttgagcatgctcagctggatgtggaaaacctatggttctcttgggtttcataaggatcaaatcccacagtgatatgtaaacttgtgtggtttatagaattataggacctcaaagctgggagaggcctgataaatcatatagtgaaaatttccagccagtgcctggatttcttttacagaatctttcttttattggacaggtgctcccttcacaatccatgatgtaaggagaaaaggggcttcgtttgaaggaagttagtgtattgtgtatgggcgtgtactttctgcttggggtgtgcctacagggctatctcactttctgaaagcgtaataataagttactttaccatgcattaattaaatgtcagagaccatgctaaatgctttacagagaatatcttttttaatctgtataagaacctcctgaggcagataatattattaaccttacttttcagataaggaaactaacattcagaaaagttaagtaacttgctaaagacatgtgtctactaggaggtagagtctcaagtctatttcaagctcctaataagtaaataaatgtctattgaatccaactaatgacatcccactccatattcccctgccactgatgagagagagaagtataaagtttatgtaaataagacagaagcaatgttttatataagcattgtggatttaattccactaagggattgatttttcatcttaatggaactttttcttcagctatcaagtttcagtttcaagatcgcaaatgctaagaagatattaaaatattttaatacataattccactagatcatatttataggtactgttaatatattaccaaatctactataaacaaaacaataaaacaaaaggctggatcaatatggaaagtagagtaataatttaggccctaaagaaaaactacgtaagacatttcttagaggattaccaggtttctctctctctctctttttaaacacagcctaaaatagaaaagcaatttatgtattaataaaaaaaatagaaacctgaggcagatgtaaccagaataggtgaattaactgaagactgatattcttatttatgtttgtgtattttaaataaagaaggagtttgaccatctcatctagttaatcattaaaaggaaactcgagccaaacttgtgaagcaggtaaagtttatttttagacattcaactggcttctcttttgggctccccttttcttttggggtcatcctccatgtctggtaaccttaacctccctgtctcttccagaaggagcaacacccccatgttttagacctttacttctgatgtcaggaccctttctgatgcaagtgttagctaactccagctggctgaagaggaaggaggaggaagagaaggagggggaataatgtattgaagtgtgtaatagtcaagtctaggagcagccctcaccttaggatctagacattcatattatataattgggaatctatttccagatctctttgctttttttttttgcaaacctcaatccaatggagtctctaagtggtagaccacagctgctccaagcttgcatcgtatcagcttagctattcctgttgagaaacaagacaagtttccaagtagtcccagaaagccaagaattaaggtgtatctgtccctgtcatgtgcctatctctgatattaccagacctggcccatgcagagttacagatgggttaataccaccataagcgcatggaccaaagttagggaaaggatagttttccaaaggaaatgttaggtcctagtatcatatgtggagaggggatacttggcaagtaaaacagtacctatctaccatgtggccacaacagggcagatcagggtccctggtaggatggaggcagccatcaagcattatggtatccctgaataatcccttcccagttcatatgtaaaccaatcctcttaaattgttaatgcatttaacataaggatggattcagcaaaactgtatcaatagcaaaacatgaggggtctccagctagtagcctgtcctgcatagccatccatgactactgctctaattgattttttctagaatgtctaaaggaagatgaaagtagaaaatgagctgtagtggacaagcatttttaaaatgagcccaataatgtagcacttttgggtgcttgataattgttgcaaatcacatttgcctgagaaatttcaattctataataattgtacaatagcagaaagatctagatacaaaaatattcattgcagcatggcttgcaatagtgaaaaattgaaaacaatttacatatacttcaataaggaaaggttaaaacaatggtatactatgctactattacctgaaaatattgaaaagatgaaaagatgtccaataacatttgatgaataaaggttgaaaaatacatgtagtaaaatctcatttttgtttttaaaaaacatatatgcatgcatgcatccatgtatagacaaaaaggatttgaaaatatacaataaattatagttaatcacatttaccttatggtactgcagaacatcagaactcattcctcttatctagctgtaattttgtaatcgttaactaatctctccccatcctccccttccccctgcccttcccagcctctgatagtcacaattctactttctatttcacataataaaagtttttaaagaggggaataatggggtgggggatctggaatatacataaaaactcaaaaataattacaaatttgttgccatcaaaatataaaaagaaaaaaatagttacatctgcaaaatgggattgtgtgaggaagtttttacctttatacatttctaccttctgtatgtttggatttttacaataagtatgtgttattttctagcatcttttgaagtttttttcttaaaggcataagtaatatctaaagttatttttcatccttctaatgccgtctacacaaagataacgatttttcttggatggccccaatctctcttctgtaagatctttccccatttgtcatatccataactcataacctcctcacccttcactgctctccattttctctataaagtgagcccagtcagtacttgtaggcttgttaagcattacttctaataagaaagactaacttgtaaagcaaatgtggaaatgtactaatatagcatcaagcacaaaatagccattcaataaccgaactatttaattccttttttttcacacttcatcctttccctaattccagaaagaacttgaactgggtcataacaaagacaaatttagacagacagataaagatatctcataggtagaaataaaactgagtgattataaactaatcacaggaggctctgttagtctgatgaacagaaacacacgtgataaaatcacagagaggtaaaatagaaaatgaaaatcaggatcaagaaaagggaaataaaaatatgctggacatcattcaataactatttgctgatggtaattatagggatggaaaacccatcaggcctatggagctaaaattaatcagcaagtattcacagagtgcctactgcttctattactggttctggcttcctgcctgcccagtgcagaggcttgagacatttgcgtgacattcagcttgtcaagacagaaggagcaaaataagcagacagaggctcactgcagccgcctatacccatcatattgttggaatcatattcaagtgagacaaactccttcagtggaagacgataaaactagcttaaaagttgtaaacatcacttcatcacccaaaaaaggcccaattaagtggagatactatttctgcaaagcaatcatcaattcatttgtgtaacatttgaaatttcaaagtacaaacccacattctattaaaggcaggaagtgaaaccaataaaacttgtaacaactatacttaattttcagggttctttccattgctgacaaacattttaagtcatgtctattctcttaaaatgtaaaatatgatgtttatgtcactgttaatattttgataaaaagctattgtcatggacatctgggtttttttctgcatgcccagaaatcccttttctcctatttaaatttaaaatctccaattatttggagaagcacctcctcttctctctctttcatttgtaccccattcttaggtgtcagtggtgggcacttgagctaggctttgcccatcatagtacacattcctgacatcccttggtcatagttattggtccagggataagcatttgaaccaactagaccagtgaaacccctcccaggaacaactactaaaattatgggaaaagaactctttccactgaagttactaacctggcaggatgtgttaaatccaggtgccacaggccaccaggtggagaggtggagataatctttccagaaaacaaaacaaaacaaaacaggaaaatgaagctaagggataaaatttaagccctttggacttcatttgagcccctgaatccagtcatgcctcctgaaattaaacttcccctggacttttcagtgaatcaaaaaactctgtttttaacagtggggtttcttataaatgcaccaaaaaatgacctaatgaatgttgtctacaagcttccattagaagtattatcttcaagagaaaaaaaaaacaaataacttgaagaaaacccttcataattcaagtcagtcctgctaacctctaggaaaccctccgtgaccaccatctccatatccacacccattttcctaaccttaaacaccagatgacttcttgaagcttatgaagtgccctatgcatctaacacatttctgtaagtctgcattgttctataatgacttgtaaccgtatctgtctccatttcctccagagaagagattgttatcattttgatatccctgcagccttatactggggcctaacatataatagttgctattttgttgaaggaattgtattttgttgaaggaattctcttttgttgaaggaatgaatggagagaatattaattaagaaagtctcttctattaataaacattccctgattgattgaaaccatgcctaaaatagctaatcatcagaagaccaaagtaaacaacatatccaaactgaatcctcaaagtgttagtcattggtagctgtatagctgagaatctttccttcttctggtcattagggttgaaagggtgggtgaatgtggagacatgattctttcttttgcaaaacatttactattttttaaactccataaaatgtaataacttctcttgaaaaatgttaaaacccaaacaaaaaaacctgtaatgtggaatatagattgtaggttataatggaggaagcagggaaagtggggaaaactgtggttgccagaagttttctgataactaataggcaagacaatagggtggcttttggtagggtccttctttatggcatagcaaagaaaaataggaatgaagaagtgagaagcatgaaaggggacagcaatatatgtgtaacacagggtgattcagtgtgagagttttataattaaaattgccaaatgtgagaaaaaaaaatctactataaattgggataggctcaaggcatggagatgaacaaataacccctccatgtgggcaaaaatcaatgaaattactagatgagtagcttagtatgtgagttccagttgcaacatgttactggtatttggggcttcccctcccccctccccccctgcactttgaggcaattcgacatttgactaacaatccagcctaactttctccatctgatataaagatatttaccttgaaatcctagaactgccaacatctcctacttcctactacaaccctccctgactccttttctctggcacagctttctatgcactcaccccattcaactaagcctgcttactcttcaccagaaggtcttctcttagcataaaaagttcctggaagtccatctctttcatagagctgctggatgactgctttgcttacctttggccttcaaaatacctctcctgtccaaccatagctccccagctcccctgccattgcaaccaatacaaacttcgtcatctttccttgggccaatgtgcctgtctcctcactgctctccctgctttctcccttagcccctacaactcatactccacatcgcaagcagaacgagcttttcaaatagtaaattagattatgtccattagtgtgttagtaaatgtttaacagctcctgaggggaacagagtatctatgtgttttataatttttacatatatgtatcacataatttacaaaaagcaagaaaaaatataacactcttaatagtaaattctatatggccatgtgattttcacagaaccatttcagtgatttttgcagaatatttgtgtccatagccaacctacagctaaaattcaaacacgtttggcaaaatcagaccacaaataaatatctgattaatatccaatcagcaaagaagtcattcatggtactgaagtcccaacatgaatgttggttgatatttttacattaatgagcgagataaaagtgaagcaacaaaaatggatgttggaactaaactcgttcattaatgacagaagtgacttcttttgctgataatagctttcaagtactagaaaaatatttcctcaagtttttgtgttcacaaactaaggcacttttaagttcaatcttcattattaaaatttcttctactctgtcagtctagacaatcaacaaaacaaatcaagctctggtttgtcatgtttcccaatttctatagtataggtactccaccatggttgatttcaaactaccaaaataacatttctgaatgcagcgttaggaagggatacgctgcatcataccatcgtatggtatgttcttatacagaacagacagaaataactttaagaacatagataatagtaaaatggagtaaaataattaggcagtaaagtcttcagcatttatttttgttgttaaaatatttgattgtgagtttataaataatttggtttttaataatgactgtgattaacaaccaacttacaaaatctctgaaaatttaacagtcagtgcttgcaagctggtacaattgtttccggtgcactactgaattatcactcccctgcctaaaattccagactgcccattgcactgattccctgggaaataagtgaaaagagacaatgataattttcatttttgttgtggtgaagtgatagtgcaaaaattccataagctcctctaagttttccaaataaagcttagtgtttaaaaacgtttgaacacatgatcccatgtaaggcctacattacttcctgtgtgataggtggggtagatatcattatccttcctttacagattgaaaaacaaggctgagaaaaatcaaatgcctaccccaggctcattcaagtaagtaaatggcagaatagggtctaaaaaccaggtcttgtattgaaaattcaacaagaggatagagaaaatttaattgacaaatactgatctcaaaacaatttttttttcaatggtgacaaatgtcctttgtagcactttggagtttgatatgaagtatcttcttatcttgttaagggatccctataccaagaatgttttcatctcaaccccactatttctaagttagcttaaaaacaaaacaaaaccctgtgtgctctaataagaagatataagaaccaaaatggaaatgcaggttctcaaatgagctgaaagattccacatagcagcggggcagattgaaacactctttaccaaaggaacatgggagagaaaaggagattaaatcaagaaaggaagaaagctaatgacatatgaggagccacaaatgccacaaatgaaaaaacaaagtacgtaatacttgttgcaattattcagtgtgcttgctctaatgcctccaaacattaaaaacattgagttcctgcttatggcaacatttatctcatttatctgctgatagctgcctcatccttgaatcaggtattgcttaaactaagttctgccagcataaagaataaagtcaaccaggacacccattgggcatttcacgcatatgagcacaaattgtgatattttaggttgcttatgatgaaatcattgaaagcatcatgaaagacagcaaaacagcaggaaagctagtaataatttagcatttcccagtccaggcgggaatgttaattctaattacaacgaggaataccaaagtggagttcattatgattaagaacttgctgtactagtgtgaattgtttataataggcatgtctggcataaaatacaaatattgaagcagacagagatggctcattcaaagctcagctgggttcccttgaacctcttaccttataaagttaaataggaatagaagtattttccaaagtcaagatattattttaaagagacaaataatagctatgatagctgcaggaataattttttaaagtaagttctaaccaccaataaaagctgtttgtgtgggcttaacatgttcaaaatacacaatacacatgtacacaatacacgtatacatggttcccatttatatttaacatcacacatttaaagtgagagagtacagaaaaaaagaataaatggaaactgaagccatgacaaagaatcacggactataggaaaataagtcacaaagaagtatgcttatgtaagaggaaatatatgtgataaacaacaggagacatgggaatgaatgtggtgtcttatgtcctttctttaacagaatcgtgtaacagacactactcaatatcgatctcaactgatccagttctccagtctccctggaaaacaatggattgatgcccagggtgcgctgaacactggaaccatggtcacttctgcacttcacacgattctgctcccaccagttgagctaccaacagttcctggtgcttttgcttcccaaacatgtttatgccatttgttgcttattactgtacttacttaatttgattaaatattaagtaaaatgatgaaatgagtgtaaaaaattgttctataaaatctaaatggaaagatgccctatagccttccttgacttacagttgcgtcaagtaaggtggatgtaagacaattttaaaagactggtgtgggggcaggagtgaggaatcataaaaatttagaaatctgcacgaaaattattctaaaagtacacattgaacatccctaacttgaaaatctgaattttgaagtgctccaaaatccaaaactttttgagcattgttatgataccacaaatgaaaaatcctacatggaagtacttaccacaaactttgcttcatgccccaaattattttaaatattgtataaaattatcttcaggctataaggtgtatatgaaacaaaaaatgaatttcctatttagacttgggtcccatggccgagatatctcattataatgcaaatattccaaaatcagaaaaaaaaaaatccaaaatctaaaacactttcagtattaagcatttcaggtcatggatactgaatgtgtatctttaatttcttgttctactttgtttaaaaaaaagggggaaaatagtaattctacagatgaataataattgctaatgatgagcaaatacttcctatgacccaggaattcgtctaagcacttcacatatatcaaactggtttaatctttataaatcagtactattattatccccattttacagatgatggaaaaaggcacagagagttagcctgcccaaggttacattccttttagtggtggagactgtatttggcctttatagtctggcttttaactgctacactatatcaatgcattacaggtatagtttatacacacactaaagaagacatggaactccagtcagtgggctcataaaagctttagaccttcatcaaaagattagaaaataaatgttcaatcacaggttttaggtttcaaaagtttcaaaagtttaaagtttgcaagttatctttcttaaaattatttccttcttttaactaatttttaaattaaactccagttcaatcacatccactagaaggcttcactttctacaaaggggtaggtaaaggtgatgatcttaaataccatactgggagttgggatctgtgtagcactagaatcaagagttattgtatatacttgagaaggagcacagcctgatttagttgatgttttggaggggtaatctggcagtacagcttggattattttagtgggaatggagatgacaaaacatgaagagaatgggagaactcacttgggtaatatatcagtttctgaaatcaatgtatcaagtggtttggttattagtcaggcttaaggttttattggccttaggacatagtctctaagaccatatattatcttcattcattcatttaaccaacacccactgagcaccaactatgcactagtgatacaggggtgaacaaacagacacagtccctgcctttgcagaacttatgttctggtgggtgatacagagaaataacaaatgagggcacaaataatgaactatcattgtaatgtgctaacaaagtatgcagaatactataagaacatacaatcaagaatctaatctagtttattttaaaaaaaagtggggggagcactcagatgtttaaacacaaaacaataaaaatgaggatcttgagggttatctgtacactttttattaacccatttggccacaacaataacccagtaaaagtgattttacatctagttaactagttgactcaatgttattataaccctgtaatgtatttgttgggtgcctgctatgtagtgggctgtgttccaggagtgggacataaagctatgacaagatagatcaggtccttgccttgactgagtctgaatacatcaccttcatttccacctctgcttctaagacaatcaaataccttcccactcagatagggattcatcctatttcttgtagtaattataagttcccagggttacagattagtaaatgccatacctaaagacttaggatactgtgcataaaacactttcaatagtgtctgtcagacagcagatgcgcaataaatgttgactttcgttagaattgtgttattattataatgctaaatctcacgtcctttctggcacactggagttcatctcttcaattaaattccgtaagcacatattgtaagtagtctatcagaattgatatactacttcatgttaatgattgagatcagtgaggaaaaccactttaatattgtctaattcctctcttaatgcataggagccatgtgaacttagacaagcatcaacctctgtaagcctgttgtcctcatattgaaaaatcgaataacaatacctatctcatttaattgttgtcagcaaaagtgggcagcagaagagtggggatcaataaatgttagccacaaatcataactatttgtattactctgaaaaagaggggttaacttatagttcatgcatgcttccaaatgaatgtgaaagactaaagaatgagaatttttttgctatcaaattaaaaaattaacaggcacatttagattgctgaagagagaaattaggataagtttttttttttttttgctcaattaaaaacgttttcaatggcatatttaaaactacgtattcttccccattaagatctgcagagaaaaaaaaatgaagggagaataattgggaactcttgtgaaatcataaattatttaagcagagtacctaccactaaggatttgagcatgtatgagcgatgaggtggattcttagagcagagattcagcagtgagacaggctaatggcatggggagatgtgttctattagacaactgtattgtccccttaattatatacatatatatgtatataatatatatgtgtatacatatgtatacatacatgtatatataaatagaattcttaatcattttaagcagtgtacaaggataattattagcatgggctatttaactcacttttaaaacgtgtaaaacattattgtagggttgggtcttgatttgtttcccatgaaactgttggtagtttaggggccaaattaacgaaagacatctcattctagtgcttgaggctcagaaattggaaaaacgggcaactaggtcaagcagtgttctcatagcctcacagatgagcatccaaagcaagggcctccttctagttgacttgtgccaagggacaggagaagcggagtctgccttctgggtccagaagggggttttgttaacatggagttgctcagcgcccttcataaaaattcttctggctgagggttctacgttggcatacggttggttccctcttcttttccgaggtggcgagtatctcttcctttgccaagatggcggctccagaatcctctggaggcggcccccgtagatcgtctccggacaagaggcttgctgaaagcctacttctttcctttcacatcagacaatgcacagggaaccgtttacccttgagaaccaaggaaggacggcttaggctacccgcgatcgcgaacctttgccaagatggtggccgcggggacgggctggcgacactgtaccctaccaagatggcggcgggcggcttccgggacgcgcttccccaatcgtcttcaagatgtcagagcagggggagccgccgtcagtctgagcgcggcgggaggtgagagagtggctgtggccgagcgcccgagcaggattaggtggagctgcggcagcccccgcccgtgtcaggagctggcaagcgatgtcacctgtgggggcgcaaaagttacctccccaaaccctaaacccacacagcacaacctttcccagagtcacaaaaatcataatctgtgccgcacaaggtaggaggctcggtcccggcatcgtccaagccttcccgacgcggcgagctggggaagggagctggggcgggggcttcccgcacgggcacccctcgccccacggccctctcctttctcaggacggaccacgagttcccttccccttggactgagggggaagctcctaacaggaacatctgtagggagttgaacgctggcattttaaagctgcctgtattttgttttatttgtaggggcaggggtcctatgaacgtgatagggtgagcaacgcacagagtcgagggcagcaaatgtcaagattcgggggtggggcctgcaccgggaacttggacgcgggccctggccggggtggaagaagaggtcaggagtttcggaaggggggctatatttcgccagcaacttactatttcgcctgcaacttgcttttaagcctgccgccccctgctttccttaatcataataataaaaaaaaagtgcaaagaaatccagctcgctggaggttttgcatttggcgtgcaacttccttcgagtgtgagcacattgggcgggaggggtgggggttgaacttggcaggcggcgcctccttctgccgccgccgccgcctcgcagactcggggaagagggtgggggacggtcggggcgcgggggagggtgggttctgctttgcaacttctctcccagtgcgagagcgcggcggcggcagctgaagacccggccgcccagatgatgcggtggtgggggacctgccggcacgcgactccccccgggcccaaagtacgtatgcgccgacccccgctatcccgtcccttccctgaagcctccccagagggcgtgtcaggccgcccggccccgagcgcggccgagacgctgcggcaccgtttccgtgcaaccccgtagcccctttcgaagtgacacacttcacgcaactcggcccggcggcggcggcgcgggccactcacgcagctcagccgcgggaggcgccccggctcttgtggcccgcccgctgtcacccgcaggggcactggcggcgcttgccgccaaggggcagagcgagctcccgagtgggtctggagccgcggagctgggcgggggcgggaaggaggtagcgagaaaagaaactggagaaactcggtggccctcttaacgccgccccagagagaccaggtcggcccccgccgctgccgccgccaccctttttcctggggagttgggggcggggggcgaagcgcggcgcaccgggcggggcggccacgccaggggacgcgggcgtgcaggcgccgtcggggccggggtggcggggcccgcgcggagggcgtgggggcagggaccgcgggcgcccctgcagttgccaagcgtcaccaacaggttgcatcgttccccgcggccgccgcgcggcccctcgggcggggagcggccgggggtggagtgggagcgcgtgtgtgcgagtgtgtgcgcgccgtggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagaggtaagaagcgaggcgggagggggccggggcgcgctcgctcccccgaggtgccgctgggaccggagacaactcgggggccgccgcgggagcctacaaacttttattagcctcggggagtgggggtggggggctggcaagggccgggcgacggtgacgaaagggcagcgcgcgggtgacagcgctggcctcttcctctccctccgcaggcgtcccctggccgggccgagggggaggaacctgacctcggacggcgagcggagccctgtcgaactgccgggggcttcgagcctctcattcctcgcgggaatcctggcctcttttctccccctagtgtcccctttccctccaagggggtcgcccgacacccgttttcgtggtgaacgctaagccgcgtctgaattttactcgcccgaatatttgcacgccaccccggcgcgcccgagcgcgagcccgggctccggggaggccccggcggcgcctggcttgaggagggcgtgcggggcgcgtgagggtgcacacgcggggggctgacagcccgcaacttggagactgcggccggggccggcgttatctgttagaagtgggcgtgtcggagagagaactcaacaggtctggacgtacttctcttttaacctcgcacttttttctcttctccacccccgccccgcaagggcttgctctttagcgtttgttgttaattcgcgcctgaggtttctaagtggccccttttagaaaaagaccccctgtaaccgtaatggttttgtgctgcgatttttacaagtgctagtttgacgtttggggttgcagacttgataattgcaaccttgtaataccacttaagaccctctggcatggttcattagggccaattaatgtggctgggttatttgcaacttaaactgggggataatgtcgcttgagggagcgttttcgttttaggaaatattgttttggtttcgggtttgaaggcagctgtcaaaaaagcggcatggaaattcattgggctccattcgatacctcgtgtttagagatcgttatcgcctcagataaacggggcagagaggtggggagataagcagtttaccctcaagatttgtagtggcaagtccacacccctctctctaccttcatattcacttttcagtgagggccagtgacatttatgctgcctaacgtcatcgcataggaaaagttaccttttattggacgggatttgactatagtgtcccaaatgcgcttctccgtcttagcccatctcttaaaacaccctgattaacgatatactaacagtcttactctcttgagaataggctgagaattgggataggtgaaggtttggataggtgaaggcagagaaaattattttgaacattttactggatacagttgtacctgaatttatatgaatgtgattttacggttctgtgtttttccatttttcagtacttcgatatttgtttggaaaggaaagaacttagagatgtaatagcatttcatattgaggatctcaagcaatgtaaacaaatgtagcttaatctagatgtttttgtgagttatgataagggtcagctatatttaagttatgtaagctaacaacgtagtgagaaactactacaccttctcttctgctctttaaaatctaaattttagttggcctatataaagtgtatctcatttcatatatccaaaatttggaggtaggcacatccagtcagaagtatgggttaaaaagccttttcccagcctgtcggaagataagcagatcagcattgtttatttttcaaagaaaacgtgcatggttcaccagttggttgtactcaaaggtttggatgtgtgactagctggtaggagggaaatttggaagtaattagggattgagaattctagcatagtatttatcaaatgttatatgtattggttctcagaaaagcaaacagccgtgattgaaaagaggtaggaattttaatgatcacacttcctttttttgaaattaaatactttgacatcaacttgaaccttcagaataatcagatgtaatgaattataatgtctgtgattaacaaagctacacgttcagtgagcggcaggatgaatagccaagcttagttcgatacacttttgccctcagctgtgcaaatggattgcattgtacttttaaatgtggcatgctgaatgggagcaggggacatggctttttattctggaagatagaaactactcttctggtaacaaagaatttgattcggagttaactaaaaggttcatttaacaagctgcctcttactaatcggatcaggaagataatgtgactttagagcttatgatgttttccccccgtttttgttttttgttttgtagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaaggtaagatcagtgtttttctgtttcttaagaatggtacatttaaggtagattaatagatgtaaatcttcattgatttatatgtgttctctaaagattcatgtgcttttttatatgaataagtttaagtggccttttgaaagtaggaaaggtagacaacctaagtgacatctgtacgtaaccatttcaggttttttccttaaatagtggttttcagtatcccattggccaacggtgaggattttatttaacatttttaaaataatgttgctcattaacagatatcttaacgaaaaattatataaattcaggagagtataatgtctcataatatcatattgtgttgtgcatggtcattcagctgttttagaatatgttcttatattacaataaatgatacccttacttacatagtcaaaagttgtgctgccttatttgtaaattcgttaagtgttagcttgagattaaagagttaaaagcagaagtactaacaaagagccctattcttcaaactgaatcttctgttaaagaatttgagttttgaagttgctaaagcaatgcagtgaacagtgtaccagaccatagtattagacacaggtcttgctcacagggttcttgccataaagtagacaagttatgtctgctgatcaatctctttaagagaggaattggtgtcaacatggtgcaaaacaaaattttacgttcaaatgttcctgcaagttctcaagtagataactgatggccaaaattgttaagcttcaattttcagctttcgtttgatttttctcttttttttactcagtcgtttataagcatactgatatttttgtctgacccaaaaaggtcagaaaatggaattatcagaaaaaagttctaaatgtagatatacgtgttggtaggggtgaatttctctaccccgtaacctcatccccaattcagataaatgctaggttttatatccattttagttgtgaaggaaaatataaaaatgtggattgtagtgacacaagattgattaatcagcgggtttttttaaaagaagacatggtagacagtgatttatttgtatgtaactattgaagttttttcttaaatgttagtgatattcatcgttcccattaactagttattcagatttttgaaaatcctttttctgtgaaagctatcctaacctggaggatgtctcttttctttcctctgtacttaagaagcttttcttgttagggaaataatttagaattagatttaggctatgttctgttcttctaaaaggcttagttgtcaaaaaaaaaaaaaaaaaaaccaaaaaaccttggttcttacatgtcttaatgtgaactacctcctaatctattgtttaaataattatcctttatttagaagaacactacttcaacctgagttgaaggtttaaaatcttttcagtaaggagatttgagatctttattattgcataagctgttgtgttttaaatgctaaaagacatgctgtgttttaaaattttcaattgcaaatttttggcaatagaattcgcatacttggttttcttaaaagagttaagtacggttgatttgactaagctatctgtaggaaactcttaaattgatttataaaacatgtaattatacaaagaaaaataaaacatcttaggaaactcttggggattattaatggattttgccctgataatcatcatggcatggttttcattttccttactataaagaaaaggcaagggacaaaacttattttccatttgctatgaacttttaaaccctataaaatctgggatatagagtataagtagatgaacatagttactcttaaatcactaaaggtgattttaatgctttaacttttatagtacttcatgacataaagtatctttacgtatttttaatttgggtcccataaccttatggaggtagtaggcaaggcaatgatgatgcggctctttagaagttctttaatatcaaatgaaattattatttttatgccaatctgtgattgggaaatataatcagtagtctgtgtcctaacaagaaggtataatactttatacagggtattttgttaatatttgaagattttataccttatggcattaacttagcactgggaactatgattacccaaaacaaagcttcatccaaataaattgaaacagtgtttcttttaaaccatcattgaattagtctattgtttccaaacaacagccctgatatagctaaaattagttgctttctcttctctatatgttacatgactgtagccaaacatttgctatgaccagtgaccctgagtgatcagcaaataatcaacacattgagaccacaacttgaatactgaccttctgactttacgaagaaaaatattaaatgccactaataacttgaattccttttaaattaaaaaaagttataaattgcaatttgactttttaaaatgccacctaaaattgtttttatcagaatacttaaaaaaaaatcctcactttattctctgggggtgggaagaggcaattccttccttccaccacaacattgaattatcacataaaattgtaaaattatgaatattatgattgagcttagtaaagcattttctaagttcatttatagtaaaacaagagaaaccttattctcaaaatctattctttaagtaaaacaaactagtcattctaacttaatatgcttttaaaaatactgaagttcagtacatttagcataaacttattgacgaaggcacatttctgcattatttgattttcagccttgtttcatttaagcattaatgacagaggtagagaacagaaatggttttaggtggtattagagcttttattgggattatgttgaaattttagtgttaaaaaattgttcgtatcctgaagggagggattattggagagaatgaatgatgtaggatgaacttgtaaattcagttttcggcagagtctaaaattaagtgatgattggcacttaatgaagctactaaaatttatgtagattttaatgtctcattagtaatcgcatctgtatctggttttataaaagtaatgaaattgaagacctgtacaaatacagaatgaatgaagcaaattctgctaacatcatgttgaatgttttctcagaaaaagaggaaatacgaagagaagagatttgttttgactgtgatttaccctcacccccatggatactttctttacttcctaccttttttctttttcttttccttctaaagattctggcaatgggtgtttcagtgttttttaagcttaatatttctggtactcatttatgtaaagtgatttctgaatgttaaaggagatttctttttaaatatattttcacttatttttagctttatgatgagaatcttattttttaaatctgtaacttgttatggctacatgattagtaaaaaaagtttttaaaacacactgtgtattcaggtgtgtcattttagtgtgaaatgactaatgcagaaatatgtgactagcatgtggtcagattttattgaaattacttacgatgtttctatggctagtccccttgtatttttataattggtaacataattcatatgttattttggtcttgtctatttgtgttacatgtattttagtctgaccacttttgctacttatttaatgtttatacattttatgaaagacttattctgaaatataccttgcataaatgtaggttaaatgcaaattgtattaatagtgaaatggatatgtgggtagagatcactttaggggccttttgagatttagtgaaggaaagattggatcaaaagggtttactttaatgtgactgcctaatgtgaaagtcggaacatctgcattaattggttagttacataaatcttagtctactctggcctgcaggtgactgaaacagcccaggaaatcttaatttacattaagcttagacaaggtctgaggcttaggcttagttcttaaagcacattcttttttactttaatgattattcctaattttaatgagcagtgggttctcattgtgtactagtacttaggtgggcaaattaaataagcaaaataggtttgtgctgaatagcatttacccttctgaggacatcctggtaatattttcatcaagagtaattgtgtaatgcaatatttacaggtatttgccagattaatgggcacttgttttcatatttctgagtcatggaaaatatacattgatgattcctgttgcataaagagttttcaagaaaattttgttgaattaagctataactacaaaaaaaaatccattacatattgacctttagaaaggatttttaaaagcccatgctgtccttatttctgcagcttcagagagccgactgctcttattttcttctggcatattctattaatacttgggttttgtatttttcaagtaaataaaatattcctattgagaatttcaattttaaaaaagaaaaggtctactaagtgttcctttccctgttgaattatgtgtgatcatttctatgctaaactagattagggtgtgacttgtgatggtgatttttgttcattttacatattaagaaagaaatagaattttattgcagttcaaaattatttgtagacagtggttttaacccccagacacctaattgtgacaggttgctttccttagtgctcaatactgttgtaaatgtctctaaatacagaatttccagtggagttcatgaattaattgggggtggagggtgaagagggaggagcaacagagatgtgggatgctatagataagtttaggaatatccagatcagttctgaaaactaacagtttggatcaactgtcatgaattagaggtttaagaaaagaaaaatttaggactataggtacaagggaatgcatcaatcagaattacaatttaatttcttttatttcaggtagaaatctaaaactgaccatggctatataatactaatttttgagttatgttgtttcttactatgctttattatcaaaaaaggataaaatgcacattttacttgaagattattttagctaagattaagttcatatttttctcatttttatttaagctgctgtttaataaatgaaaatctaatgacttgaatgtagtcgacctaatgtcttaatgttgatataatcatttcatatatcatagtgcccttttacagccattgtcaactgactggagagcaacccttttctttggtaatatatttctatgggttatgtatttttctgctggaatattgagaaaattaatttttcataatatgcagaataaattatggggttctgcaagtgctagacagtcacttaaaccatttatattgcaatacattccttaaattcagtattttgaatgaaagtgtgttatccccgaattttatcacttgtccaatttaaatattaattacatcccaatagagctgcatgcttaaacatgctttttcagagtaacccaagtattaatttcgagtgcttttaaatattttttctttttagcaagtttcaacaacattaatcctgtctataatgcagcaagttcagtgaaagtacctgttgttttataatttttttttcattctcactgtagggcaccaaaaatatatataaggggaaaaaagttttaatgatatgattagttgtaaatgtttacgcattatcttaccttgaatttttatttttgtaactaataatttgagagttcaataagtatgcagtgtttaagacatagtttgttgcaaaaagtgttaacttactatttctttttacaataaaattagcctttattctagttgatttcataactgtccataatatttagctgtggctattatgaaagtatatttgatagccaaattttgaaagctattatgaaatgatacaattcactacatgatttattatttcatgctggttggggcagtgctgtgacttatgaccttatgattgtcacatgctgaacactaaagctctaccagtttgttatggacactgttttactttatgttatcgttttaatgttttcttttataattattgaggataagagcttccttaattttaagactatttaaattgcagattttgcttttttatttttttaaccatcccttccaaagaatttgatttagatattcagtagtagaaacagaagaaaaatactcaactaaaagtccaaagacctagtttctaatgctaagggagacagtccatggcctccaactaggtactttggagtcaaaaatactttctttacaactgtgtttgaattgttttcaaaacacctgtgtgtgtgtttctaaaattccacaatccttttaacccgtcaatttgatgagggaagtaattagggtagggaatggtataacaaagttggttctttgacattttctttatagattatcgaatgtaagacaaatagatgtgaatgcagatttggtgtttttataagataaggatttaaaataatgtagttggtgatatataaaaataaactattgctgctgttagcacccgagaggtggggctcttgggttctcagagcttgttttctatgttcgttacagttattttagattagaacttaaaagaacttgagagtttccctaattctaccccctaattttttcgaatgagaaattgagatccatagaaagtgttgaggtaaagatcacaaaacacttaatgagcggtgttgccagtttgaatatctcaattcttagttatctaagttccctggtaggcttctttaattatctgggtctcttctagacatctggaacaaatagttgattgacataatacagactagccacatattttataagagttacttttgactcatttagatttttaaaatatacagtgtctgtattcttctctattcattttgttaatttttttttacctaataatgattaagcaccaattatgtgacagcactatgctaagcactttgcatgcattcatctcatttaaatctcaactctgtgaaagtttttattctagttactgtattaagtctcaattctgtcaatatccatgaagcacagaaggcagctgttatttaccttaattttacagatgtgaaaactaaaggcatttaaagagaaaaagaaaaaaaaaaccaggaaaccttaacacttatctgaagggaaatatttaatattgggtatgttagttcctcatgtatctttaataatttttgtcaacagcgaatctttaaataaaatataaaggatcaggcctctgctctcctgcatatatttgtaaagtcacttactgctttttgtcacagtttcaatttctgtaaaatagtgagagggtttttacctgacaggatttgtgcatgtacgtttactttgaaaattaaaaagcattaggccaggcgcggtggctcacgcctgtaatcccagcactttgggaggccgaggcgggcagatcatgaggtcaggagattgagaccatcctggctaacacggtgaaaccctgtctctactaaaaatacagaaaattagccgggcatggtggctggtgcctgtagtcccagctactcgggagcctgaggcaggagaatggtgtgaacctgggaggcggagcttgcagtgagccgaggttgcaccactgcactccagcctgggcgacagagcgagtctccgtctcaaaaaaaagaaaaaaaaaagaaaagaaaattaaaaagcattataaaaatgcaaggtggaatttttaaagctctgccaagtccacttagcttaaaccagcatgactctcattggctaagtacgttatgacatctgtgactgtggtgtaggtattgcctataatcaagaatcttttagggtctgctatgtgcaatccctgaagggtcatggatcgcagtttcataaagactgctgtattttaaagccttcaaatgccaacgtagtatcttcacaatgattttttttttcagttttattattttttgaaagcgccttcgacaaagttttcagtggattttgttgagggatattaagtatgccatctacataatagccatagtgataactccaaccacattgttatatttttattaataaatgctagagtattctctttctggtatttcctattctgatatttttatataatcaagtatgcaaagattctttgtcattggaaaccttaatttgcctgaaaatgggaatgaaattttcaggtttaaaatttttttacatttattacatttattgaagctgtctgaaaaagctcttgagtatattgaataccaaaatttatcctaactgcataaagttgggaggattgtgaaacttgactgcactgacttgttttctttattgatcaaatggttgaaaaaaacttcagttaaacaaatttgatctattaaaccaaagttataaaagcagaggaaagcatagaattattaaacggcagtttaaattggtaaacataccgatgtagaacctaagtttgtaggcagctttcttagatggaaacttaaaaaaattttaatcagaacattatgtgaaatttgtcatctggaattcagctgggtttattaaggacaaagtgtatggctataaaatagattgagttttttttttaaaacagaaaacccaaaataaatgttctaagtttccaccttaggaggctatgtatattgctcctctttgaaactgccttcagaaccaccttgtaagccataaaagaaaatcggactcattgcactatagtaacacctaactgttcttgctcaaagaaaatgtatttatcccttagctttatttgtgtgactccaaatcatatgagtattgccagatatttagaaatttaatcctctctcgaatgataacatttattttctttgagggtttttaaaagagcccacatagatatttctacagaaaatgtttaattctgttttgaatatgcctggaataagtgaatagcttcccagggtgactattctgaaatgggtgatgcttagtggttaagttctgatttgtgttttcttgaagttattaaggaactttatgataacagtttatatattccctcttcttggcatagtaatgaagtaatagagactattcacctctaagcctgattttttaaataagtgtttattttatgtttaagtaaggtaggtctgcttttggcttggacttgaatttggcaatagcagatataaagtaaacataatgtgaattcctacaacagtctcccaaacagtttaatttctcattcatacacatttcccttagtgtatcagggaattaagtatctgattatcagtatagcaagaacaactcaagtatactgaagttatttatactcataaaatagtttgagttatagctacaatataaaattaatatatttttgacttttattcctcacaacctgaaaaaaacctctgcgattactgatagtacttttaaaaactaaatgaattttgttactactatttgctaaatttagtcatgtttactgttcaaaaaatgctaggttaaaatggatcctaatctttgaaatgatgaagacatgtgtagtggtgtcaaaaataggatattcattttgtaactattctgttagtgccgaagttcttagaatttctttgtgacaacagcctgcttaagaactttagattttttagaattgtactaaaagcaaactgttttcttggatatttgttctttctccccaaaagatgatttataagttttcagagctaagaaatgggaaggaagagccatcctagcatggcaggtaatgttttactgctaacaggttttctctgcactgctttatttgccttgaacctcttactttgttctgtcagctgggaggctggtagattttctattaggtagcaaatgcttctcatcactaaacacatatcatgggctggtgttagtgcagtctgtggatgggcactacatttttaatcaagaaatgtttttaaaggaaagacaaattggtgaagtaatttctaattcagtattttagggatgagtgaccttttaattgataatgatatttaacagagctgtacagtgctttgggggtcccacagacatgtttaaacaagaaaacagtaaataaggaagccagaaggaaaagttataaaactattaagaaagaaaatgaaaattctaaacttcaattctggtgcctggctaaatttgatttttgtatgcctcagtgtttctctatggacactgggaaatcaataagcaacctagctacgttattatgttcgtaagtggaagaactaaagaactacaaagacatgttctaggccaagaattctggtggtaggtagagtgggaggttaactagatgatctccaaggtccttctaattgcacttggcagcagcaagcatttatcaagctagacactgggcatatggagatgaagaagatgaatatccccagcagcatggagagcactctgatgatagtcatccctgcctccccctccctcagtttgctttttgaaatgtgagcttgaaagatctcaaactccttcctgggaagacataactgaaacttcatggaggaaagtgcatgaatgaatgggaaacaagatttgattcaactatttggaataagaaaaggggcaacaaggagtctgaaacaaatgaaagaaaagatggaaagaattagttgactagatgaggactgagtacataggaatgagccaacaggagacttcagcaactaatggatgaaagtattatgtgcatgcatgttgtcatcaaatatcacatgatacaagacaaggagaaaacatgactttcaccataacctcagtttgtgtaccctagttgcaagatatttttttcttctagtcacttaagaatatccttattgtctaggagaaataatcctctttctgggctccccagtgtataagcccaaatctgaggaaaatttacctgaaatgttctttccccagatacccacatggtttactctctcatttaaatgtcagctctgtaaaagagatctctgactgctctatctgaaatagtagaatctttcacagtctttccttcttcttgacatcatctatttgtgtcttatctgctcacctgctacaatgtaagctccatgagagcagtgatactgtctgccttgcttactcctgtatgccagcgtctagaatagtgtctagcacatagtaagacctctacaaatacatgttgaatacctaaataaacaaaatttaacatataaaccaaaaagatatataggaatggattatatttctaatctttctcgagtgaggaaaatgtcagcagatagtgaatatcactgagagagagatgatagcccaggttatcttccccagatagaaataagccttaagactgacaggtgtatatgaatacagagagtatacataaagaagatgtattttcaattgacagtctctaaatttgctttaagacttcgaaatggattgcttttcataatttcttagaataactctggtctgtttaccattgaaaaattagagtagccaatgtttgtaaatgaagggttagagggttttttcctttggtggtttgttaaaagcttgctcaaggcagtaacatagtaaattgtcaatataggaacttttgtagcagaagctttatgcttttcacttttataagaattgagattatttaagcagatgagtctaatgtatatgtttgtactgacttacctagaaggtcaggcaagaaatcggtttcctcatttttcagataagtgtgtgtgtaatcactgagtaccttaagagaggaggggtgttttatttttgcctgaattttcaaaatatctttcttcagcttatttatattttagatttgacttattctgtctatagtatataacagtcaggaggttggtaggataagttcatctcttctactaagagttataggagagttcaacctaatatggcaatgacagtcgcagaaaagagaaaatgcaagttaagtaggtgttagccatagcaagaaaatcagatgaggtcatttaagaatgaactgctctaatgttcaggaaaaaagaggggagggacaaggacagggctctagaaggcaaccaaagagagcagccacaaaataaatgaatagctgaagaattaggagacaacaatcttaaaatgtggcagggagagggtagttgtcacattaactagcatagaagagacagaatagaataacataaatatatgagtgattattgttcttgaaaccagtctttaaaacatgggaacattcccaaaaatcaaagccagataaattagggaaatcttaaatggcacaatataactagtgatttcgtttataatttttttaaaaaggagacttaaatttgaaatttagatgtaattaaagcagataataagaaacatacttctgagaccacaaagaccctgagattcagttaagagtaaggtagaaaggctggaagccagaagggaattaagtttctgttccctgagaagccaacacaacaggaaaaaactggccacaccctagttcaaactcttattactcttatcaatagtctcctaattgtttctctagttttctcctctcccttcttaattcattctgcagtctactgccagattaatcttcctagaacaccactttcagtattattcccctgatcaaaaaatgtctgtggttttgttgctcatagcatagtggttctccttctttgtaccacagcccatatgcacgatgatagatggtgggtagccacatgaactctccataacctttggaggatttgggttatacacagtctgttatccaagaaagcatatctgagtgtaagtgagcattatagggatagtcttataattgactccttttaaaatttgttcttctttttgcaaatgccccttcagaatttacagaaatagtgtgttcattccatcagtaaaattataccccaaaatgttaataagcttatttccatcacgtctcctttcctatttctttctttcctctttcttcctgcacatctccccttatcctccacatttctctgtaattacataagcataaacagacacatatgagattttctgggttgcttgcctttaaataaaagaatgggattatcttatacccctttgtctgcagcttgcttttctcacctaacaagtacaccctgaacatccttccaggttaacagatgcggatcccattcttttaaatagacaatattctattcatgtggtttcgtgatttttgccactacaagcaagtttctaataaacacccttttctatgtaccctttacaaatagcaactttttttctaaatataaatgctatggtttggctctgtatccccacccaaatctcatcttgaattataatcctcacatatcaggggaggggcctggtgaaaggtgattgaatcctggaggcagacttctcctctgctgttctcatgatagtgagttctcatgagatctggttgcttgaaaatgtatggcacttccctcttcactcactgtctctcctgctctgccatgtgaaaacatggtttctttgccttccactgtgagtgtaagtttcctgaggcctcccagtaatgcttcctgttaagcctgtggaactatgagtcagttgaacctcttttctttgtaagttacccagtctcagttagttctttatagcactgtgaaaatggactagtacagaaacttggtaccaggacagtggggcattgctataaagatacatgaaaatgcggaagcaactttgtaactggataatgggcagaggttgcaacagtttggaggactcagaagaagacaggaagatgagggaatgtttggaacttcctagagacatgttgaatggttttgaccaaaatgctgatagttatatggacaataaagtccaggctgaggtggtctcaggtggagatgaggcacttattgggaactggagcaaagttcacttttgctttgctttagcaaatagactgacagcattttgcccctgccctagagatctgtggatctttgaacttgagagagatgatttagagttcgtggcagaagaaatttctaagtagcaaagcattcaatatgtggcctggctgctcctaacaacatacagtcatatgtgttcacaaagagatggtctgaagttggaacttaggtttaaaagagaagcagagcataaaagtttggaaaatttgcagcctgaccttgtggtagaaaagaaaaacctattttctggggagcaattcaagtgagctgcagaaatatgcatagatgaagagtagcctaatgttaatagccagtagaatagggaaaatgtttccagggcatgtcagagaccttcatggcagcccttcctatcacaggcctggaggtctaggaggaaaaaatggtttcgtgggccaggcccagggttgcgctgctctctgcagcctcaggacatggtgccctgcatcccagctgctctagctccagctgtggctaaaaggggccaggagataatcttgggctgttgcttcagagggggtaagcctcaaaccttggcagccttcatgtggtgttgggcctatgggtgtgcagaaggcaagagttgaggcttgaaagcctctgccttgatttcaggatgtatggaaatgcctggatgtccatgcattctgcaggggcagagccctcatggagatcctctgctagggcagtgcagaggagatacatggggttagagcccccacacagagaccccactggggcactgcctagtggagccgtgagaagagggataccatcctccagactccagagtggtagatccactgacagctttcaccatgtgcctggaaaagctgtaggcactcaatgctagcctgtgaaagcagctgcagggtctgtacccagcagagccaccagggcagagctgtccaaggccttgggagctcaccccttgtgtcagcgtggcttggacatgagacgtggagtcaaaggagatcattttggatttttaagatttaatgactgtcctgcaggtttttggacatgcatggggcctgtagcctctttgtcttaaccaatttctctagtttggaatgggggaatttacccaatgcctgtatcccaattttttcttggaagtaactagtttttgattttacagtctcataagcagagtggacttgccttgacccaagaagactttgtacttggacttttgagttaatgctggaaggagttaagacttccggggactattgagaatgcaagattgtgttttgaaatgtaagaacatgagatttaggaggggccgggggcagaataatatggcttggctgtgtgtccccacccaaatctcaatcacttgtaatccccacatgtcaggggaggggcctagtgggaggtgactgaatcacaagggtggacttccctcttgttgttctcatgatcgtgagttctcatgagacctggttgtttgaaagtgtgtggcacttcccccttctctctctgtctcctcctctgccatgtgaacatgtgcttgcttctccttcaacttccaccaggattctaagtttcctgaggcctctcagtcatgcttcctttgaagcctgtggaactgtaagtcaattaagtctctgttcttcataaattatccagacacaggtagttctttattgcagtgtgaaaacggaataatacaatagatttccccaaagttgggttcctgagtcaggggtatgtgtatttaaaattttaacagatatttccaaattacttttttcgaggattatggcaagtcacagttccccctggcagtgtttatacttttctttataataaaaatacataaatcattattactaacaaattccttgccatgagtcctaaattgataacaacataccagtgtgccatataacatagctgaggactgttgcagtctagaattcaggctccttctctctgcttttaacaatatgtgtaatgttcaagaccaatttagtgccacttattttgtatgctttcctttatgtagtccaggccatagccccccacctcatctgatggtatcctctggcagccacagaccacacagttctttctacctaaattagtcattagcacatagtaggtacccagtaaatgtttgttgaattaatactgtttatatatttctaatttatctccaagtaaatccagtctccttaaggacaaggaacgttttcactataacacctagcacttaaggtactcaatttaggtagggctgtttgaacaaagaaccacagaggaagcaaatagcatggccttgcctttaatacatatattttactttctcttagggaaaactggaactgtaagaatctagtaacaataataagaacagcacttttattgagcagttactatatgtgaggcacagttcaaactgcagaggatacaacagtggacaaagctttagttgtttctgcctttctgaagcttatggtttatgggtgttacattcaagacatttgtaggacacattctaaaatgccatccaatttcaggctctttccagcagaaactgtggaatatttttccgttcattcagcatttacttagtgcctgctctgccaggaattgaagagaaagcccaaagacaggcagaccttacctgagaggtagtgaactgaccaggatgactgtgggcagtagacttgtttcccaaactagcctcaccatttctgtatttgcatatacgaggaaaggattagatatagggattcatgtcagcatacaccccagggacatttgtttttagtgaaaggtgccagtcttcatccctgtacccagtacacaaaccacgaagaagtatgctcccgtcattgtcaaagaatcatagaattccaaatggagctagttttgatatccagatctcacttcatatgaggaaactaggtccagtattgtgagtaagaattaggactcttcagattccctgggtatgaatctgactaacaactgtgtgaacttgaccaaattcataaccctgtaaactctgtttcctcacttttaaaatgggcacaacaaagtgatgcatgtaaactgcatagcacagtgtctggcacttaaaaagcactcctgaagttatttttagtgatgtgttttaagattagacaactccttaatgccaaaggtttttacttgagaactctgtctgttgtgccatactacacgctgttcataagataagcctttttcattaattgatctcaaactggcttcattatgatcttaactttatttcagttttatttttaaaatttatttttaatttttatgggtatatagtaggcatatatatttatggggtacaggtcatgttttaatgcaagcatgcaattgtgggggtgatatataattgactggggtgagatatctcattgtagttttgatttgcatttctctgatgattaaggatgttgaacatttcttcatacacctgttggccatttgtatgtcttttgagaaatgtctattcagatcttttgtccattttttaagttggattgtttgattttttcctgttgtctgaactctttatatattctagttattaatcccttctcagatgggtagcttgcaaatattttcttccattttgtgggttgcttctttgttgtttccgttgctgtgcagaagttttttagcttgatgtgatcccatttgtccatttttgcattggttgcctgtgcatttgaggtattactaaagaaatctttgcccataccagtgtcctggagagcttcccaaatgttttcttttagtatcctagtttcaggtcttagatttagggctttagtccatttttatttgatttttatatgtggtgagagataggggtctagtttcattctgcctatggatatccagttttcccagcaccatttattgaagagactgtcctttccctagtgtatgttcttggcacctttgctgaaaatgagttcactgtaggtgtatgaatttgtttctgggttctctaggtctgtgtatctgtttttatgctagaactatgttgtttgggttattatagttttgtagcataatttgaagtcagataatgtaattcctccagttttattttttttgttcaggatggctttggctattccggggcttttgtggttccatataaatcctatgattttttttttctatttctgtgaagaatgtcattgatatttattaataaagattgcattgaatctgtagattgctttgggtagtatggacattttaacaatattgattcttccaatccatgagcatggactatctttctttttttgtgtgtcctcttcaatatttttcctcagtgttttattgttttcattgtagagctctttcacttctttcgttgagtttattcctaggtgttttattttatctgtagctattgtaaatgagattactttctgatttcttttttagattgtcctctgttggcatctagaaatgccacagatttttgtatgttgattttgtatcctgtaactgtactgaatttatctgttctaatatttttttggtggagtctttaggcttttccaataagatcatacagtctgcaaacaagaataatttgacttcttccattccattttggattccctttatatctttctcttgtctgattactctaggtaggtcttccagtacttccagttgaataacagtgggcactcttgtcttgttgtagatcttagaagaaaggctttcagtttttccccattcagtatgatactagctgtcagtttgttgcagatggcataactttcaaactaattgattatagttaggaagtggatactttaacttgtggtaccattatcagatttatatttcggccataagcttgaagaggagctgaaaaatgcatatgtgatgcatatgcttcctatttggctctcttctcccacccccctgccctataatccacacaagttcctctctcagtcactcatcaactacttgaacctctgaggaacttggggttaaggtaaattagaataaaactgtctgaagaagagcaagcctttcatgtcttgagaaattcttggggttttagaaataacttcattgctttttttctccagttactttggcttcttcttaaagagaatactaacactttgaacgtcataatactaaggttctgcctcttcaaataaagactttaaaaaaaaatggtttttgtatgattcagtgtgaattaaatcccacagtgtaaaggactttactttcttaatgtagattttcaaatacacaattactgatgtttataagtagatttattacaccaaagcacctagcaaattcttgaatggatcaggtcttatttttcagtcttactttgcaaatttaagtcaaataattaaggatttgttaaatatttgtcttaatatcaagcttttgcatatcggggccctcttttataagctttataagcaatcttttgttttctctgcttgctcaaagtagctatgtttgttgtatctgttagtatttgctctataacaaacatactgggtgccttcccacttagatttggcaattatcactcctgtaaatgagatattacataagataggaaaaagaacagtatctttccaagaagaatagtatccttccatattaacagtttagagctgactgcttttaaaatttagtggctttaaaataacaaccatttattattcttcatgagtctacaaatgaggtgggcagttctgctgatctggccaagctgaacttatctcagctgggcacattcagcgtatctgctgtcagttggctggttggctgtagcaatgaatggtgaaagtaggctgcccttaactttttcacacagtagcattagagttacaaaagaaccagcagaaccatgcaaaactctttaagacctaggcttggaacaactatatttctaccacattctattggtcaaagcaaatcacggggctagtctagattcaagtgggtggaggagctgcaattacactgcaaaggagtgtgactgtagggagaggtgtttttttatttttatttttttgcgatttgtcacagtagttgtaggaatcaggtgtatttaaaattctgatccttctgtgatatccgaattgttcatgaaccttgcctctggtggaaaggcagaatcattgtgacagaaggataaaatcttggaatttagagactaacaaaggttcagattccagctccatcacttatttctgcaatcctgcagaagttaatcttcctgataggcattcagtaatgattgattcacctgaacctcagattctttatgtattttaaagaaagggctaggtaaatgcaaagcacttatgtaactgcttttattattgcaaacctggctcccacactccattcaaggtgtaagactcagtgtcttccttgaattaaaaaggaagagaaagtgtgttagggaaaggaagagaaatatttgactaattgtggccccaataaagtgaccactcactgggggtattttcctgtaagaaaagaatggttgaggctcagagttaagagatacaaatccaaaagtctccttggggtaggattccctgtgattcatgggttgagaggtgtaacattagacacagtcccagtctagattttttttttaaagaattgtagtccatcctatacacactgggtgccttaatactatatgtggcaattatcactcctataaatcaggttttacataagataggaaaaagaacagtatcattccacattaacaattgaaagatgactgcttttaaaaaattaaaagggccatatagaaataaaatcacataaatttcttgtgttaaacatagttgtcatattggatgaggactaaacacctaaattcatccaactagtagtaatagaaaagatgaaacacacacacagtaaaactagattaatttaatttatacaaagggccagatatctcagaattcagacagtcagagatgttgactagagttaatgcctcttttaggagaggtaccaggtaagtgttctcaaagaactggaaactgagaccaccacctctggcattatctatttgtgaacacaagcaagtctgaatttttccgcaccatagctacctttcatgtaagcttcttttcttagaagaaaagaaggtaacatttgggtgtaattttttattaagggtgaaatttagtgtagagagtaaaggcatttggcatagaagcccttagttttttttgtttttaagttgaactgccagcctttatggattgcagtcttcgctgttttgattgacatttcccaattcattttgtattatttatttttttaagagacagggtctcactctgttacccaggctggagtgcaatggggcaaacttggatcactgcagccttgaactcctgggctcaagcaatcctcccacctcagcctcccaagtagcttggactataggtgtgcaccaccatccttggctaattttttaaatcttttgtagagacagggtagtgctctgttgcccaggctggtctcacattcctggcctcagttgatgctctggtctcagccttccaaaatgctgggattacaagtgtgagccactgcacctggcccccaatttcatcctttacaaagactactttcaaccataaatcaacggaaacttcagctccctcagacatatttgggatccaaggatattttcccaaatgattaatgctaatttcatatcaatacatttttgcaaaacctacaaaaatggactagtaaagaaagactcttaatttgggaaagacagttacttggagagaagagaaacttaagaggcaggtcgagttcagtgttcagaaatgagaggatcataaagagatagccataaaaatgtttctccctatattgcctgctgatagggtgtatcagtgaaggtcttactaaggaccttgtaccttttcagcgctgcactgcgtgctcatagggaggaaagataaatcatgtgttttttctgacctcaaaggagcctgtatctggctagagagacatgatgcagacacatgaaataattaagaaacaattaactgtagcaggtgctgaagaatataccaggaggtcagagaatggtagagctagtgtgggcgaaggtatagcccagagcatcatcagatgattcttccttatgcaaattcacatctcctctgggtcaagtatcatcctggcatgcagcagctccataggtaatgccctaaggctagcctgaggcaagttgcaaaagccatcatattgagtcatggcctttttttgtgtggggggaggggaatggcatccccttcctgtctgccaaatcaaggaatacagtgccctcctaaacctgctttgttttagtggattgttaaaaagaagtgaatgaatttatgcttcattagggaaaggttacagtggaatactgaggagtaaggggtatttctatttaacaaatgacataacttgaaggaatgaaatcataaggatggaatttcaggcattaataaaaagctgatgagagatactttgagacaaaagagccttcccagtgtaaccgagatcacagcacctacttcacatacacaggaaaccagtcctatctgtctctcccatagagcagtagctgccttgtttttcctccctcctccatcattcattctaaatctccagtcctccaccgcaccttatccaaaccctgatacccttaagtcacagatggtgaatcagtcaaaagtagtattaaaaactagtggtacacagctacacctggaatgcagtaagaaaaatacggatttctgtacatcatcttccctccctgctcttacccccatttaagagttacagggtcagaacccaagagtctgagtttttgaaagtccctaaaaattttggatgatcacctacatttagaaccactgcactaagaaggacaacaaatatgccaataaattctgttgccaaggaggtgattatgcaagctggaaccctgataacatgaggagaatcccacaatagccaaatagtccatgtactagttacattataataaagccaaaagcagcaggcctacctgactttctcctgaggtctatcatgagcttagagagaaggaacgtggacatatagaggtagctctagatggagaagggcactaggtgtcatggaaagaatcatgtgcaagaagtaaagaggtgctctgaatgtcctagccctgcttaggtgtctgtgtcctcacatgagaatttatccacagttctttcccgctgtaacaatctttggttccaactgcatttgtgagacagcaaaaagctatggtccagtctccttccattgtatcatctcatcaatgtatttctcccactacccttgtgtgaaatacaaacttttttggcttattgtgattatgcaaggtgtatgccaactttttttttttctccacatctttcagctttctgatgggtaaaaattttccttattttgctttagaaaaattctcattggcatagatctaatttcagggagcctcccttgaaagctaaataacattgagaattcatgaaaatataatgtagagcattatgcctgttagcatattagtttaaatagaagtggttcatgaaaatttttgaaatgccagaccctgtcctgtgttttgtattctcccaaatactcatccagatactgttcagaatgtaacatgattattttgaaataaagattttcccctagtttttaaaaaagttactttatacattaacccttatgttcctctttgatcaatttttccagtagtgtaaacagtcttcagggaagtagatttcttacagaaattgtcaagtggctctctgctgttagcatggttactaatcttttggttacttttcatattttttatactttctggaagtggacaacttacttgtaaataaaagtgcataatttgtattaaaaatttttagtaacaatctaatttgtaaaatagatgtgagcagcatgaatgtgtgtgatatgcgtacatacgaattatgtctcttaaaaatgtatcacagacatctttccgtgtccaaacaaatctacctcattctttctaatagccatatgggtataccataatatatttaactaggcccctattaaaagaattttgactcttttgtagctactatagtgttgcagtgtgtatctgtgtatgtatctttgtgtgtgtatctttgtacgagtgtacatatattttccccttggctatttcagatttttttttaggtttaaatcttaggaaaggttttgaaattgtcttaagtattttcagaagcattaaatcatggtttttttacatttttcttttagaagttttatgtcatctctatgagtagctttcagtaatttgttctgcataaaattcccgaaaacttccatttaaaaataggtggcatgactagactttctcagccgaaagagtgaggtcccaggaaggattttggagaagctgtgttcaaatatagctgctgacctgatgtctgcctagagtctggcaaggtgatgtgttgaatctagtgtctgcctgcatgccagcatccctttactgatgagatttgtggttttcatcacttcatggtaatcatcccaagttataagatggagtctctagaaaatcagtagagtatgaaggcccaagtaaaatacatgtgagtgcatgtatgtgtgcatacaaattacttctcttaaaaacgtatcctgggcatttaaagaatgaggacctccgaaggattttgtggaagctgtgttcaagtacagctgctgagcgtatgtcagcctggagcctggcaaggtgaagtgttgaatctagtgtctttttgactcactgttttttttgactcactgtgctttgaagcccttgtcatttgggctcataaaatagatttctgtatactgtctctcctccctgccctcgcccccatttaaaagtatagtggcagaacccaagaatcagagttactaaaaactctctagaaaatttggatgatcacccacctgatcatgtcttttttactcactatgttttttttttttttgagacagagtctcgctctgtcgcccaggctggagtgcagtggcatgatcttggctcactgcaagctccgcctccctggttcacgccattctcctgcctcagcctcccatgtagctgggactacagggcctgccaccgcgcccggctaattttttgtatttttagtagagtcggggtttcactgtgttagccaggatggtcccgatctcctgacctcgtgatccacccgcctcggcctcccaaagtgctgggattacaggcgtgagccaccacacccggccctttactcactatgtttttaagcccttgttttcatttgctccactgtaaaacattccccaagccaatctggagctgaggcaaatttttaacaatttaaaatctggggaatataaatattggataatgatcatcctgaaaaaacaatgaaggtagtagcataatactttatatatcaataaaatggcaaaataagacagttgttgaaggacagaaagagtaactgaagttaggagcttatcttaacacattttttgtgtcataccataggcatcatattttttaaattttttttatttcatacacataggaaaatatatgtgtgtaagaaataataaacacctctttgtacctaccacccaacttaaggaacagctcattgctattccctttggtgctcgctggatgccctttcccagtcacatccccctcccttcccatctgcaggactatactagtaaattttgtattttttgcattattttgctttgttttatgattttactacctatctacatatccctaaataatacattatttagtttcatatgttttaactttatgttgtggaatcacattaaatgtagtcttttttttttatattatactttaagttctagggtacatgtgcacaacgtgcaggtttgttacgtaggtatacatgcgccatgttggtttgctgcacccatcaactcgtcatttacactgggtatttctcctaatgctatccctcccctagccccccaccccccgataaatgtagtctttataacttgtttttttaactcaacattgtttgtaagattcatccatgtaagctgaagcttttttatagagatctttgttaagccttttaatgaatacagtacatacatttctctgttcccctgttagtggacacttggattgtttccagagttttgctgttttgaacaacgctgctgtgaaaatgtctcctgaaacacatttataagagtttttttttccccaagggaattatacctagaaattgaataactagatcacaaggcatacacatctacaacttctgctaggtaatgccaaattgtttccaaggagcgttagaagtgttctcatcaacttttactagtgctagtcttttacatttgtggcagtatggtgggtgtgaaatatttatgtttagtttttcttggtgccatttaataatttttataaaaaatatttagaagtcaaggcagttttttgtttttgtttttattttttgcttgttttgttttaatgcagacattgagattacgacttggaataaacattggttgcaaagttcctaaaaggaaaactttttttggtattctggagcttttctggtactgaataaaataagtatgttaaattatgcatgtgtagtttagaagtcagagcaataattgtgattgttgaacagaatggcagtaaaaagtttctaaacgattgtactgtacaagggacacttgttgtgggtcagttttagcctccccaacttttatgttaaaagttgcaacaaggtttaagggcttatgtttgataggccagatggtgaccagctgtgataaaacacagggaacccttgcaaaggatttcaaaatttatgcagtagtccgccttatctgcagttttgctttccaaggtttcagttacccgcagtcaactgtgttctgaaaatattaagtgaaaaattacagaaataaagaatcgaagagttttaaattttatgcttcccacccatcccacctgggatgtgaatcattcctttgttcagcatctccatgctgtaggtgctgcctgccccttagtcacttggtagccatccaggttatcagattgactcttctagtattacaacacttggcttcaagtaatccttattttacttcatagtggccccaaagtgcaggagtggtgatcctggcaattcagatatgtcaaagagaagctgtaaattgcttcccttaagtgaaagatgaaaattctagacttatatataaagaaaagaaatcatatgctgagactgctaagatctatgataagaatgaatcttttatacatgaaattgtgaagaatgaaaaagaaatgcgtgctggttttgctgtcatatctcagactgcaaaagtttgcagccaatgtgtatgataagtgcttagttaaaaggaaaaaggcatttaaggtaagtatatatagtgtttggtactacctgtgatttcaggcatccattgggggtctcctgagtataaggggagactactcttttagtgttaaatgaacactaaggaacagagatggggaagaggttggagaagattagttcagcagtttgagtataggtaaacagttgtttgagaaagaagaaaaatgtgattagtattttaccttagcaatagtggcatagataatgataaattatagtcacacagaactcttagtatttacagaacgttcacatttgtgatcccatttaacaataactctgaaagaaaggtatcatctaccactgctttattgataaagatataaaaggtaagagagatgaaacatattggccaatgatacccatctggtaagagacagggatggggtgggaccccaaggctcttctcgccaagcccacggtttttttgctttatacttttttgcctcctgatcaccatggctgcagtttctactgtggacaatgtctgtcagcaagcattgatcccctgccttcagcactcttacgtcttagcaaggactggaaagaaaaagccaggagtttacagtctgctggagcaacagaaaagaatgatatgaaatatgaagagaccaaaatgatttataataaggtgctagactatgtagtaaaaatctgctttagctgtaagtcaaaagcaagagcagtcttttcagaatggaatagaaatgttggaattaaaggaattttcaaagttgtgaatttttttcaagataaacatgttttattttggtaattatggtattactaatttgataaccttcagggagccacctaatattatagaagatgtacatataatgacaaaagcaaacattttatttttaaggaccacaatctaatctaaaacaaaatttcccccttttctggtctttggttaattaaggacttatttaaatatcaaagaaagacacatagaaaacatttagtatatttctatacttttattaatgtcctccataccttacacagatacttgacttggctatggtctagataatccatgaaaatttaaaggacagattttaacaactttatgctaaattgatagatctctaggatcagattgccatcactctcagatgcgaagcttccaaccacttataggttcctgatatcttgcttttatacagacctaatttctcttcctttaaactttcttttcctcagttgctatttgattgaaatattgagtcattaaaaatttccaagtgggaatttttgtgtttcttcatctatcatgaagctgctcaaataagtaggtgtttgaataggagtagaaacagtaataggctgaagccagaccaatacagcttcagctaaatgccgaccttgctaaagtctgggaggaccggtgtggtattctacaatgtacaagtctgtagccggtgcccttaatatgttggcttcatgtctcatgactctcttctgtaaatatgcagtttaaaaaatacaagttattctgctgtagaagatacatttgcaaaattgatgtatcccctctaagtaaagttggctaaacaataaggacatatttataattaatgaatttgagaagaatgctgacgatatgcattattctttgaagttaacatttttcaggtcctaaataaacaaaaagtaggttacttctgtctggagtgtatgcaaggggtaccatcttgtccttggttcctggctgctattccaaggtgctataaagtcagctaaagagagcaatcataatacattgatagcatccctcaatgtgtttctgagctacttgagaatcttatttttgaataggtagcaggaaaccatctttgcagggcagcatgggcaaagggattggagggactattattataaagatccactgaactgcttcagtatcataatatcttaaactaaaggactggaaagagccagattccaatttaatctgctcttctatgaattcttagctgggttcatttaaaaagaaaaaacttgaagattgcaagattttgaagacatcttaaaataggtgaactccaaggtgcactttaaacttgagactgataactgaatactccttcaccttttgatctgatattgtcaaaatgaatgaggacttagtgctctagtaagtttggaacagaatgatattaatttattttctcatgattgattcttttttgctttttaatagattaaacttcaccgtagaacagtttctcaacctctggactattgacatttttgattggataattctttgctgtcagggctgttctgtgtgttgcaggatagttagcaacatccctgacaatcacaaatgttactttctgtctctatggatttgcctattctggacatttcgtataaatagaatcatatatatgtggcttcttgtacctggcttatttcacttaacatgttttcaaggttcatccatattgtagcatgtaacagcacttcattttctttttatggctgagtaatattctgttatgtggatatactaccatattttgtctatccactccttagctgatggtcttttaggttgtgtccattctttggctattataaataatgctgttaagaacattcatatacaagtttctgtgtagacatatatctttatttctcttgtgtggatacctaggagtagaattactggatcatatgataactctatgtgttaccttttgaggaactgccaaacatttttctacagtggctgtatcattttacactcccatcagcaatgtataagaattccaatttctctgtccttgcctatatttattaactgtcttttcttattagccaactgctgtggttcgaatgtttgtcccctccaaaactcatgttggaacataatccccaatgtggcagtattgagatgtgaggcctttaagaagtgcttgggtcatcagaggtctgccctcatgaataggctaatccattcatgagttaatgtactaatgggttatcactggattgggactagtggctttataagaagaggaagagaactaatctagtaagctcagccttctcactatgtgattgctgccctgtgtcaccttgggactctgcagagagtcctccagcagcaagaagttcttcatcagctgtggccccttgaccttggacttcccagcctccagaaatgtaagaaatccatttcttttttttaataaattacacagtctcacgtattcagttataccaacagaacacagactaagacaccatcctattgggtatgggtatctcattgtgttttttatttgtgtctcccaaatgactaacgatgttgaacatcttttcatctgctttttggacatttgtgtattttctttgaagaaatgtctttaacattctttgcccattttaaaattaggttgtctttttattgttgagttgtcggtgtgtgtgtgtgtgtgtgtgtgtgtgtgtgtgtatctagaatatatgtgtatgtatatatgcagatatattctaaacactagacccttatgaaatatataatttgaggacaatttctcccatttaaaaggccatcttttcacttcttgatagtgtcatttgactcacaagtttttaatttttatgaagtccaatttattttttaattctttgtttttggcactgtatctttaaaaagttgcctgatctaaggtcaaactgattttcacctatgttttcatctaagaattatagttttagctcttacatttaggcctttgatccattttgaattaatttgtgtatatggtgtgaagtagggctctaacttattcttttgtgtaatgatacctagttgtcccagcaccatttgttgaaaagattattctttccccattgaatggtcttgataccttgttgaaatcaactgaccataaatatataggcttattcctggactcacaattctatgagtctgtatgtctaatcttatgccagtaccacactgttttgattattacatctttgtacaaagttttgaaattgggaaatgtgagtcttccaactttgttcttttttaagattactttgcctatattccgtgttcgttgcaaactcatatgaattttaaatcaactctccatttctggaagaaaaaaagaggcaattgaagttcagatagggattgcattgaacctgtagatcagtttggggaatattgccatcataacaattagtaggtcttccaacccatgaatacaagacttctttccatttctgtagatatttagtttctttcattaatattttgtagttttcaatataaaagtcttgtacttcgattaaatttattcttgaatattttgggttttgatgcttttatgaatttgttttcttaatttcactttaagattgttcattgctactgattagtaatgcaactgatttttgtgtgttgatttttgtatcctgcaacctagctgaaatcattgattagcataatagagtatttaatagatttaggatttctatatataagatcatgtcatctgcaattagagataattttacttcttccctttcaatctggacattttttacttctttttcttgcctagttgccctagctagaacctccagtgcagtgttgaatagcagtggtgagaatgagcatctttgtgttggtcttcatcttgtggggaaacctttcagtttaagtgtgttgttgtggggttttcatagttgtcctttatcagattgagaatgttcctttctgttcctagtttgttgagtgttttctttttgattgttttaatcaggaaagggcattagattttgtcaaatgctttttctgcagctattgagatttttgtgtgtttttctggtcttttatggtttatcacattaattgattttcatatgtcaaacaaaccctgtgttcttgggtttcatctcacttggttatggtttataatcctttttatatacttgtagattcagtttgccagtattttgttgaggatgcttgcatttatatttataagggatattggtctgttgtagctgaccagtaagtatagtaagctgtatagtttactaagtgttccctctgttttgggggagactttgagaagaaggattgttggtaattgttctttaaacatttggtaaaattcactagtgaagccatctggggtcttctttggaagttttttgattactaacttaatgtctttacttgtttgttataagtccattcagatttttttctccttgagtcatttttgacagttggttgaggaatttgttcatttcatgtagttatctaattggttagtgtataattattcatagtattcctttataatcttatttttttgctgtaaggtcagtcataatgttcactctttcatttcggattctggtaatttaagagtcttctctccttttttttcttggtcagtctagctaaagtaaagttttgtccgttttcaggggaacagctttttttttttttttgaggcagaatttccatcttgtcacccagtctagagtgcagtggtgcaatctcggctcattgcagcctccgcttcccgggttcaagagattctcctgcctcagcttgccaagtagctgggattacaagcgcccaccaccacgcctggctaattttttatatttttagtagagacggggtttcaccatgttgggcaggctggtctcgaactcctgacctcaggtgatctgcctgccttggcctcccaaagtgctgggattacaggtgtgagctaccgtgcccaacccagctttggttatttttgttgacctactctattgtttttctcttctctatttcacttatttctacactggtctttattattttcttccttatgcttgctttggacttagttcttctttttctagtctcttaaggtggataattaagttcctgatttgaattcttacttctttgtaaggtggtcatgtactgctatgaatttccttctcagaaatgtatatgctttcactgcatcccttaagatttggtatgttgtatttttgttttcatttgtctcaaggtatagtcttctgatttccattgtgatttcttccccctctaacccgtttattatttaggaacttgttgatttccacatacctgtgaactttccagatttccttctttgttaattctcagtgtcattccattctggtccgagaacatactttgtatgatttctatcttttaaaatttatttggcttgtcttatgacctaatacattgtctatcctggaggatgtttcatgtacacttgagaagaatgtgtattctgcttttgttgggtagagtgtttgacaggtgtgttggtacatagttctgttcaaatctgtttccttgcagatttctatctagttgttctgtctattggaagtaggatattgaaatctccaactaatattgctgaattgtttattgttttcttcagttctgtcactttttgctttatatattttgaaattctattgttaggtacaagtaagtttatgattattatatcttcttgatagattgattcttttatcattatacagtgccctataagaacaatttttatcttaagtctatttgtctatattagtatagccacttcagctttcttttgtttactgtttgcatggaatattttcttcttttactttctatttgtgttcttgagtctaaggtgaatctctgtagatagcaattggatctgccaatctttgctttttatttggggagtttaaaccattgacatttaatgtaattattgatgaggaagattacttctgatattttgccatttgtttcctttattttgtgtctcttgttcttaaattcttccattactaccttctttcttttgtattacatattttctagtgtaacgattttaatttctttgtcatttcttttgttgtatgtttttagttattttcttagtggttgccacggagattttattgtcattttaacagcctaggttgggcacagtggctcatgcctgtaatcccagcactttgggagactgaggcaggaggatagcttgagtccaggagttcaagaccagcctgggcaacttactgagatactgtctctacaaaaaaatacaaaaattagccaggcatggtggtgtgtgcctgtagtcccagatgcttgagaggctgagttgggaggatagcttgagcccaggaggttgaggctgcagtgaactttgatcacaccactgcactccagcctgggtaccagggcaaaactagcccaaagaaatgaaggaaaaaaaaaatctaatttagattaatatcaactcaacttcaacagtgtataaaaactttgcctctgtatacctcttctgcttccactctgtgctgttattgtcatagattttcatctttctacactgtgtgtttatcaatgtagatttaaaaatattgcttagtagttgtctttagaatccgatacggagaaaaggagatataaacaaaagatgcatttttactgtcttgtatgtttacttatgtaattccctttcctgatgttgtatttctaaaggcaaagtagggttattgtgagtgtccttttgtttcaacctgaaagactccttttagcatgtgttggagatatgctaatgatggactctcacagtttttgttatctgggaatgtgttaatttatccttcatttttgaaggatagtgttggcaggatacagaattcttggttgacatgtaattctttcagcattatgaatatgtcatcgtactgtcttctgacctccatggtttctgataaggaatcaactgttaatcttattgaggatcacttgtttgtaatgacttgcttgtcgtgctgctttcaagattcattctttgcctttagcttttggtagtttgattgtgatgcatttaggtgtgtactttattagtctgttctacttggagtttgttgagctttgtagatgtatttcatcagatgtgtcaagttcttttgccactattttttttttaaataatctttttgcccctttccgctccttctgtcactctgattatttgtgtgttgctttgtttggtggtgtcccagaagtctctgagactctgtccagttttttcctccccattcttttttctttcacttcctcagactggatgatctcaatttgacctatcttcgagttcatggattttctcttctccaagtgacatctgtgagatgaatttttttctagagaatttttcatttcagttattctacttcaaaatttctctttggttcagttttatcattgctatctttatattattctcagtttaatgagatactgttttatactttcctttagttctttagacatagtttatgtcactgaatatatttaaaatagctgattttaagtctttttttttttatttttttggagatggagtctcgctctgtcacccaggctggagtgcagtggcacgatctcagctcactgcaagctccacctcctgggttcacgcaatgattttaagtctttgtctatgaagtctagtatctgggcttcctcaggcatagtttctgttttctttctttcttttcctgtgtacttcgtttctttgtataccttgtaattgttgttgttaactggacattttgaatattatagtgtaacaactctggcagtcagactgtctcccctccccagtatttgttgttggtgagtattgtagatgtttgtttagtgacttttcatggctaattctgtaaattttatattctttgaagattgtgggcaccctgaagtctctgtttgttagtttagtggtcacctaataattaacagagatttcattaaatgcctagaagcaaaatatcttccagtctttgcccatggcctctgtgtatgcattagggcaggccttgaactcttacccagggagtttacaaccctgccttagcctttactaccagcttctgcagagcattaaggtcaacaggtggtgagagtttggagcctactccatctttcctgagcatatacacagccctactcatgcatgtggccctctagatttccaggagtatgttggaccctttcaaagcccttacagactccccagcttttcctctcaatctttagactagtgtgttgttttcttcaacagttatctgtcaggcagcagcaaattaagagattagcataaatgttttcaactcctccacccgtcatgtgccccagggaagcactaagccagttctaagttaggcaaaataaagacaatccttttgaggtggtcttccatggagtcaccagacaggtaaaccaaataattaattacaagtctttggctggatacagtggctcacacctgtaatcccggcactttgggaggctgaggcaggtggatcacaaggtcaggagattgagaccatcctggctaacacggtgaaaccctgtctctactaaaaaatacgaaaaaataggtggctgtggtggcgggcgcctgtagtcccagctactcgggaggctgaggcaggagaatggaatgaacccaggaggtggagcttgccgtgagccgagatcacactactgcactccagcctgggtgacagagcaagactccgtctcaacaaaaaaaaaaaaaaacaagtcttcatgaaagaggtccattctgctgtctttcataccaggaatgtggaatgtggactgttattttcatggctactgctaagctaggaatcaagggatagatggggactgggtaaaacaccacagagtttgctgttcttaccaagaataagctggggaagagggttgtttttgtttttcagtaaaaattccctgggctgcttcaagccgttgattaattttcaggttccgaaaaagttcagtttgacagtttttgccctttttatttgcttttatggatatgtagaacttgagttcttttttccaccagttttgctgacattgttttaaaagcactttttgtaaaacccaaatgttgtctctctcaaggctagccaataattaaaaatactgttactcccctttgattttggaaatgaattcgtattgaccaaaattcaatactagaggtctttcaagctgttttaccatttatctaaactttagaatctaatgattcctgtacattgtctagcatactggtggtcctcaattgtcataagttcaactttggaacaaatgaactttttgtgtgcaagtttccaattgtttggaaattacattgatgccccctccatcaaactgttattcgtgggacatctaggaatttcttacagcagctgacaaatatttcaagtcagtgcctggtagtactgtccaccaggcaacagcttcagtagtagagcgatctttatctataaggcagtgtttgagcaattgtttattagtgttttcctaactactcagaagaactatcaggggttatagaggtagctcagagagttgggtgcaagtagagaaatccacccggcttgcattacacatcttatttctagagaagctttcctttgaagaaggagttctaaggtttaaaaaattaccttgaatgccacttatattgcattttaattttattttagagaaatcaatggaaagtagaaaaattaaggcactgatactagtgttaagaatgttggttaaagcttctggcaattaattttttatttccttttttaattttattaaaatttaacaattttcagtttatgctgtaatccagaccaaggtttcaatctaatgaagttaatgccagtgttgctgctacctattttgtctttagtcattcagccatgcttcctacttatactgaataagctagcttaatctaacaatcaaaaaagaaagctgttgcctaagttaagaaaaacagtttgaactgttttcaaactaaatacccagtagactctctagttgttgacaggagaatgcttaattcagaattgtcctgcagtagatcattttatctcattcctgttcttctataggatagcttatttgtttgaaattgtatttaatatgttgtgatttttgtgtgcttgtttctatttttcactggatagactcaagataaaacctggtaccctgcagtgtagctatcagtttatagcagaggaaatttacattagaacttggctgtgtatttacatgtatctaacttggaggtcactctgcttactgttgatatatcagtcatattagatgagtccctaatgagataccagaaaccccggaaacatcattaggtggaacagtgtccttaatgctttattaagtgttataggtaagacaaagcctagtactatttgtggcatcaaggttaggtgtttaaagacctgtattcttctattgtcatgttgaaattgttcccttgatgtagcaatagaaaattttagattaggcttaagttaatcagcaaacaaagataaaagtctgatactatcctaaatattttgtgtttctaaataatttaacagtgatccaattagctactcctgtagaaatgtaattgataaacttttcactctcttttaaattgccatcttgaattttacctgttttttaaagctgtctcaagtcctctctaaaaaaaggcagtcatttataaatttagaaaagcttgatagcacagaaagtcacagaaaaatgtaaacatagtttaaaactgaattgtatacaagccactagaagtacttttattaagtttacaaatattagtagagtggaactcatgcatttaatatgtttgaaacttttgatcaaatactgtgctatgaaaaacattttagataattattctttaatcatgtgtgtgtaaaatgtggctttttttgacaaccaagtagcttttctgtgtgccaaactgtgactttaaaattttaaagtactcaacagagtaaacaaaccacaaataccacttaaactgtacacatttgcacatgcatttcctataaatagtacatgggtttcaagtcttcacttttgaaattcagaaatgggttttttctccttccagtagaaataaaaacttgatttattttatttatttatttattttatttttgagacggagtctcgttctgtggcccaggctatggtgcaggagggtgatctcagctcactgcaacctctgcctcctgggttcaagtgattctcctgcctcagcctgccgagtagctgggattacaggtgcctgccaccatgcccagctaatttttgtatttttagtagagatggggtttctccatgttgggcaggctggtctcgaactcctggcctcaggtgatctgtctgtctcagccttccaaagtgctggggattacaggtgtgagccaccgcatccagctaaaaacttgatttttaaaaatccaaatcgaagacagaattgtgtattttagtacatttattagcagccttgacgctataccatatggctgtttatcatttaaacagcttgtaaaagcaaacacttcaggattcatgagtggcagaaggactgagtactttgggaaataagagagaacttttgttgaggatggttgaggaagagtccaagacaataataggcagaataagcaaaaatctagagactcattgtaggcactcaagtatgtatttgttagaatgaatggctgaacttggtatattgaggaacactgagaaagccatactgactggaagatagttcctacaagaaactggtgagacatatgttacagtctagattttggtgagccttgttaaagtttgggctttatttttatacggggagaaagtttcacaggggtttggaaatgaggcttggagctgttaatggggacacagtgaggttttagggtagtggctttcaaactgtttaaatccaaactttgatgataaccctgacataactattgtttataacttccatttcagttgtattggttttatcaaaacatcttcattgatcttactgattgcttcctatgcagattaatattataaatttgaatgtacaaaggaagctttagcagtaaaatagcaacttttatctgtcttacgtattggaggttctgcataagatttaattttttttttttttgaaatggagttttgctcttgttcacggggctggagtgcaatggtgtgatctcggctcaccacaacctctgcctcccgggtttaagtgattctcctggctcagcctcccaagtagctgggattacaggcatgtgccaccatgcccggctaattttgaattttagtagagacggggtttctccatgttggtcaggctggtctcgaactcctgacctcaggtgatccgcctgcctcagcctcccaaagtgctgggattacaggcgtgagccaccgcgcccggccaagatttaattttttaaaagaaaatattttgctaagggtttggaaactcttgttttagcaagaatggattaagactgattaaaactaaaggcaaagaggaggctcttatgtttggaattctttgctaatatttacacaatataattctctccacaaatatttaatggtaccagatattagatggttataatggcaaaagtgttcaaaggatgctatcatattcatgattcatgatcaaaatgaacattataaggctatccctcttcagaattaaatacgttactcctgtggaaaacttgcttttaatgtagaagttgtcccagagcctttcttcctttctcatgtcctcttatgtccactgctgagctaacatgggtctcactgaatgattaagaaaaaacatcttaggtggggagttctgtatatagtaaatgtttaatttattggggtggtgaacgggaagtgctgctggcaagagaggatgggaagagaaatctacccaaatccttacccgctttacagaacataaacttcctattcagtagtacacaataacttaacgatcaaggcatcttaacttttctgttttcagatgaaagaactatcgtttggcttgatcaagtatttagtatttattcgttcactcaagtgcttacgtttttttgttatctcagggttttacgttagttattaaccaaaagaactagttttagttctggaagtctaaaatatataagagaaggtgaggagtaataagagaagatgaagggagactttcggaatggcctatgaacttctagtaactataccaccttaaaatagacaaattacaatgcagttatgaagatatgtatttttcagtgaagacaactaaaatgtttgcacagaattttcttttttattgagtgttagaaattctattttggagatactaccttgcacaacataaaaagaaaaagtgagtgtggaatctaggaatctacgtggctctaggaaattttttaagtgtggaaactgaaggagagcaagagaaagggagcatggcattcccctgtttgtagttcatgaggtgggtttaaattgccttttgccaatgcagctgcacactgaggattacagaattctttttaaatgtttgtagaattatttttcacttattaggtaaaacgtgtattttttgattttctccaatttcagctttctcatgttgctatgctcaattttgtataccatatatagttttgttaaattgacaaagtggtgttttttgttcttctttttcccattggttaaaatttaaagagaaagtggaagctagaaatttatctaaaaaatgtaactttccctgtaattattaaagtatcaatctaaatttgaattttctttgtgcataatcttttttcaagctatttaccatgttgacaaacttgctttcctgtggcaaatacactagcaatacgttataaatatgtaactttcaacctatttacagttgatgcttttttagccctttggatttaaaatacaagcactgaagaggtgaggaagtaccactgctgcctcagcattatttcgaaattctgtttataaactatacaatttccaaggtcatgaatccagcacctttccaggtactaactattgggacaaagatagaatttgattttatttatttacctattgactgaagtctaacttaaatcttgcacctagtaagatcttagaaataacgtgtgtactctgacctgtaaactaatcctagtattctgtgtgtatattctttctcatttgggctcttaaaaggaaaagtaacgtacatctgatgatcattagcactgagctttttcagcaaaaagtatatgtttataaagaagtataggataatttagtaatttaataatgtgacaacatttgcgtgtgtttttttttttgagaaatacaaattgtgagaaacagaaaagtaaaagaagcagcagcagaaatatcactataggatcaaaagattgcaggaaccaaaactccaaaattattgggcataatgtactaaaaacagggcagtggaggaaagggacagtccagactagctctgagggtccaaagaaagtattaaatattgttactggagtgatttgctctgctatttgggcttgggaattaagtgaaattgttgatatactagacagatacttcccacccatttttctcttgataatcagggttcattttttctattttctatttctctggatgctccatttcttaatattaatattaatattaagctctcagtctttatgctaaaaattggttatttaaaacaatttaaatcaacttcagtctaattggcttaagttcaaatccattttaagatcgatattgtgtcctttaaaaattttatttaaaagatatttaaactgatgagaggatactacccattccactgataaactattactgtaagtttgtctattgagggctagttatttggtttaaaaatgctgagattatggaaagtggattggaatattttggagcaatattaaaaacagtatctgtaacaatttaataaacttataaattcctctttctctgttgatctatcttgaaaagacactctatgtctctaggcattccttctctgtggtgtgattggtagacagggagtaaacaacttactgtaaatgggcaccatgccagttggcttcaggcagcatcaagcttgtgactcacagtcagggttaggaaaatgccttttaacttgtttgtctctgcctcttttaaacattaaaggcacaactgtactaattattaagtatttcataaggtcttttagggcttataagatcttttaggaatggcctggaagttattagtactgtttcattgaatctgaatacctttaacatgataatgagaagtttttaaagggtggttttatagttaaacggaatttctcaaattggcttgctccttatgttgatttatttaggatcacatttgggagtttctctgccctactttcaatgtatttaatttactgaccatcactatttggggggaaaatgttatatgatatttagaaaccaagagttttggagtttttcccccattagatgtatttatttatttatttattattttttaaagacagggtcttgctctgtcacccaggctggagcacagtggcatgatcctagctcactgtattcttgaactcctgggctcagactgtcctcccacctcagcccaagtggctaagtatcaagtaagaatcacctggcaaattccaaggctgtataccagatttcctaaattagaattttggggttgggtatctgaattttagtaaagccctccaaatgtttctggtattgcttctaagaacaattgataacataatagctgtggccattataggggtattctgtcatatttagatataagcataccttgttttattgtacttcccaaatattgcgtgtttattttgttttgtttcacttacaaattgaaggtttgtggcaaccctatattaagcgagtctgtcagtgccatttttccaacagcttgtgctcattttgtgtctctgtgtcacattttggtaattctctcaatatatcaaactttttcatcatttttgtatctgttacgaccagtgatcagtgatctttgattttttctttttttttttttttttgagacggacttttgctctgtcacccaggctggagtgcagtggttcaatcttggctcacagcaacctctgcctcccaggttcaagcaatcctcctgcctcagcctccccagtagccgggcctacaggcgtgtgccaccacgcctggctaatttttgtatttttagtagagatggggattccccatgttggccaggctggtctcgaactcctgacctcaggtgatccgctcaccttggcctcccaaagtgctgggattaccgtgccagcctgatgttactattttaattgttttcaggcaccataaacctcacctgtataaggcaccgtacttaattgataaatattgcgcatgatctgactgctcttccaactggccattccctgtctgtctccctcttcctgggactctcaaatccctgagagacaataatattaaaattaagctaattaataaccctacagtggcctctaagtgttgaagtgaaagagttgcatgtctctcactttaaataaaaagctagaagtggctaaacttagtgaggaaggcacatcaaaagccaagacaggccaaaagcaaggactcttgtactaaacagctaaattgtgaatgcaaaggaaaagctcttgaaggaaataactagtgctactccagcaaacatgtgaatgatcagaaagtgaaacagccttcttgctgatacgaagaaagttttagtggtctggacagaagatcaaaccattcacaacattcctttaagccaaagcttaactctcttcaattctatgaaggctgtgagaggtgagaaagctgcagaagaaaaattggaagctagcagaggtcggttgatgaggtttagggaaagaagccagcgctgtaacataaaagtgtaaggtgaagcagcaagtgctgatacagaaactgcagcaagttatgtagaagatctagctaagattactaaataatagattttccatgtagatgaaaaagccttttgttggaagaagatgccatctaggactttcatagctagaaaggagtcaatgtctggcttcagaggacaggctgacattcttgttaggggctaatgtagttggtgactttaagttgaagccaggtctcatttaccactccaaaaatccgaagacccttaagacttatgcttaatctactctgcttgtactctagaaatgaaacaacaaagcctggatgacagcacatctgtttatagtatgcttcactgaatattttaaggccactgtaaagacctgttcaactgctcagaaaaaaatgattactttcaaaatattgctgttcattgacagtgcacctgggctcacccaagagctctaatggaattgtacaacaagatggatgttgttctcatgcctgccaacacatcatccatttgtagcccatgaatcagggagtgatttcaagtttcaaatcagtacattttgtaaggctatagctgctatagacagtgattgctctggtggacctgggcaaagtaaatcaaaaaccttctgaaaaggattggccattctagatgctattaagaatttgtgattcgcaggaggaggtcaaaggatcaacattagtagcagtttgaaagaagttgattccaacagttatagatgaatttgaggggttcaacacttcagtttaggaagtcactgcagatgtggtagaaacagcaagagaactagaattagaagtggagcccgaaaatgtgacggaattgctgcaatctcatgagaaaacgtgaatggatgaggagttgcttcttatggacaaatgagcaaataaatttttttcttgagatggaatctactcctggtgaagattctgtgaaccttgttgaaataacaacaaaggatttagagtattacataaacttaattggtaaagcagcagcatggtttgagtggattcattccagttttgaaagagtttctactgtgggtaaaatgctatcaaacagcatctcgtgctacaaagaaatcttttatgaaaagaaaagtgaaacttcattgttgtctactttaagaaattgccacagccaccccaccttcagcaaccacctctctgatcagtcagcaggcatcaacactgaagcaagaccctccacaaggaaaaagattacaactcactgaaagttcaaatgattgttagcatttttaagcaatattttaagattaaggtaaatacatttttaaagacacaatgctattgcacacttaatagactacagtatagtataaatataacttttatatgtagtgggaaaccaaaaaattcgtctgacttgctttgttgcaatattcactttattgtggtctagaaccgaacctgaaatatctcagaggtatgcctgtattaatattattttgcaagtaaaaaacccagcatataaaaaaaacgtagaatatgttgagagttcagtaatatggatgaaaatgtttttctctaactgaagaacatgataaattataattagggaaggatataaaccaagaaaatatgtctgagatagccaattcttgcagttcataatatgaaaactcattataccaatctcagtaagaatacttttaatagctgttatttctttgggatatagaatttataaagtacacagtaatcttcttatgatcaatcctaggatcactttacaaccacttaccccatattacaatgtagtaccaagacaagcagaccaaattatagaaggacaaagtttttgctaagcatattttgtcatcagcataccgcattgtgtgtgcatgcatgtgtgtgtttgtgcatgtgtgtgattgtataaaatattagaaagccaccccagaaaagttaaatgactaggaatgttgtgaagggattaagctacccctaaaattatataacaaaactctcttcatctattattaggtcatctttagaacatcttctcttaaatttgttataggtctctctcatctgtttggattaaaattggtctgaaagcctaaaatggctttttacctatataattatttcccaactagcttgtagtataggtgcaaagctatcacacttgctaggttagtgaagtatgtaaaaactaccatctttcaattaggaaccatcggatagcttctacaggattgctggggagaacctttataaagaaagttatatctttataaattttttgtcattttacttagctgagaatataaaataagttagctaataatagagtagaaatgttttctgtaacagattaatattgatcaaatgtgttattaaatgctaaaacaccattttttttctctgtaagccatgtgtttcatgccacaacacaaaagggacaattgtctgtgttttatgacagttctgttctgtcagatgctgtttgttcattttggtgaataaatgaagagagccctggacacatctttttttcctcaacaaaagaggaaaattattcttgtctgtatgtctataatcctgactctttgaatggctttaatttttttaaagtcagcatttttttataaagataggtgtttggaatgtgggcgatatggctggacagttagattgggaccaaataatggaaggctttgaacatcatgctaagaggtttgggttttactctgaaggcagtagagaaccattatgtttttaagccaggattgacttgttctaagctgtaccttagaaatattactctggcagttgtacataggatgagctgtatgttgctttgttttgtttggggagacagttctcgaagagagactacatacgaaggcagttatatgagtcattactaaaggtctggcaagaagtagtaaaagcattaactggagtggtagcagtagggaaggaaataaaaggatagatgtgggagtcatttggaaagtatgaggcaattcattgaccttacagaatcactggttttctgcttccactccattcacattgacctttccaaggttatcagtgacctgcttgtccttaaattcagtgggcactttccagtaacctactgttggcaccagccctgtgctagacaccaggatcctgtttgtaaaggcatctgccagtggtttctgtgacacaattctgtttctagttttcctccttctacttctctagcctcttggcaagttcttctttcagagtttctcagagctttgtgctaggccctcttctcattttctccttctctaagtgatcccatccttttctgttgcttcagttaccatttgtccttatgcaaaggacagccatatctactgtatctccagctcagatgtatctctttgcctcctgacccatatttccaactatctaactgggtatcttttcttggatgagttataggtctctcaaacacaacatgtccagaataattcattgacttattctaaggcctgcttcctctttctcctgtagtccctatctcaggaaatatatggtgctatcaaccccaaagcagaaatctggacataatccctaactacccttttcccctctctgtgcacataatttcagtcattaggcctcatagattggactaaataaatacctcgcaaacccttctacttatattcttaactgctcctaccttaagccaggctaccataattttgtagctggatgactgcatcatcatcttgactggctcccttgtcatcttcaatctatattctatactgcagctagagctttcaaacataaacatgtgatcagattagtcccctctttagaacaccctagggttctcactgtcctgagtacagtctaagggtttaccatggcttacagggtcttttatgatttggtgagctttttattgtataacctttctaaactgcctttacttccctctttcttggctctgtgtctttgcataatgctgttccctatacttcacctcacgtctaaccttcatctccttttcacttctcctcttcctccaaaatccagctgaatatcacattgtcatgcaggcccattcttgatctcccacgtttgggttagatatccctcttcagtaccatcaccgcaccaggtgtgtcccctatcctagcatttgcctcattgtattacaactactgtgtactcgtctctacagctcctgctagtctaaaagttttgggagagcaaaggttcatgtttgtgtttttcactgtggtataccccagtgcctagtatatgataagctctcaaaatatttgttagatgtatgaagaaatgagaaagagaacaggaagagggtaagtttcaagactaggaaacaaggctatgaaagctgcaggaaagcagcaggttaaaacctagaagaagagtttgttttaggaaatactgtgttttaaaccactataactgaagcaaaaacccaaggcctgggtgtggatagagtccactatctgataacagtggatactgatgcatggcagagttggagaggaagagagccagattccaaaacagaaggggtaaagtcttctaagaagatagattatagtaagaaggattaggggatagaaatatgagcctgttccactcatagatctcaaacatgaaatgatgagtcatcatgaagagagtaggcaattgtccagtgaagaaggggatgctaacccttcttaaccttgaatctctcaggtagaagcagttagagaaggaacagccatcatcagatagtgttgtaaggaaaatgatatccttggggaaacctgcattttggtaaagcaaagcaactaagaaagaatatactaccactgtttaacaatcgccacaaaaagacagtaggatcatctttgacccccctcatcctttctcaggaacttggaggactaagaagagagaaatctgtagaagaggcttctctctctgatcctccctccacttcagttttaccacatgtaatgcaacaataattaagaatttgtgtaaaatttcaccaggttggcatgcatggagagaaaaattattcagatgttttcctttgtcaataatacaaggagcatttgtagggaaaaatatttacaaatacagtaagacctattctctttctatatttatgggaaaattttaagttgtgcccttgtttcatgtgtgtttctatttaaagataccatacttaatatatattgttgattcattaacattgaactcatggctaacagcactataaatcatgtctgatcaaaacttatgatacatgtactttcttcgtaaggtacatcatagtcttctcgtacatgggaactctaggtagtacttcaggactatgcatagaggccattttaaacagcaaaattcccaacaaaaagcacaaaactcaaaaaatgtgccactaaatttaccatgaaaaggacacttgtttacagtttgagagctaaaacaagaaggtggcgtgtcacttcgtttgacttcagctgggaacatgcatatcagtcgactcaaattttttgctattctgtgcttatccacgaatcgataggaaagcaagtgtggatttgggggttacaaataaaatgtagcaaatgtgtaaacttgcagatgtggaatctacaagtagttagaatcaactatgttagtctgatcattaaatcagttttttaaagtactattgtaacaccttataacctgccccattcactgagtgttgtagtttatagtttcattgggcattttcagtagttttatctgaagtcacatttcaaattttgtaattgaagctccaaagtatgctaccggaaacacgagctgatgctgtgagacaaaatcaacaggtaatccaccatcacaactgtgggctagaatgctcaagaaaccttggaggcccagagagctgagatgaatactgaagaatcataggcaggtttactctgtcaagctgcctgtattttgagggtgtagtcctcaaaccaaaaagacaccaaatgaacaaactcagatggcctcactggggaacagagattgaaagctgacactggaatgtgtacttaaaaaaatgagagcccgttttggaaaggcagactgggcacagaatgtggagagctatatttgctaactgaagaaatttagactttatcctctacaaaacaaagctattggtttttgaaggttgcataaaagctgcattttagcagcatatattttggtagagctgttacctgcctgaaaacatcaatgtcatttcacacaaatgatacttatcccttggtgtttgatctaaatttctacaatgagaatgtgattttatagtctttactggggaaggaagtaggtttttcaggccgaaattcttgtgtagcaaaaattaacacttaagttagcccttggcaatctccagttctataatggtaaaatggatttcccagaaagtcactctctatccctttgaatagacattagaaataacatgtactttaagtgggatttacagaggaagggggcctttaattctttactagtgtgatgccctgtaaaaaaataactaacattagagttgaggcctagaaatagcagcactgggttaaagtctgttttcaagtgcaagtttttctttttattcgtgtgtgtgtgtgtctgtgtgtgtttcacatagaaggaggaaatgccaatttcagttcttacaaatattaatgactgcaacttataaaaatgttacagactatattcttcccttttgtaacagatgagaagattttgaaatttagtctctactttttagtttggtaagacaatttgaataaactgcaataattgcaaaagaattctgaatatttgaacatttgacattttctatgtcaaatatacatttcttgtactatataaacattctagaaaagagagacaggcagggaggaaagtgctcattaaaaagagcttcaccctctctgaaaagggatttcctttacagtgctgtgtactaaagcctgtgttgtaaatcagaaagcactgagcacacatgttgctgctttggtagcatcagaagtcgattttcattagccttataccattcactatttctgccaagcaatcttaaattataaaagaatcttatttgattttgtgattctcttgttttctgctcataaagaaaatatcctaaattgaacaatggcatgctacgtttttagtttttaagacagctaatgtgtaaaaagacatttaaagtatagttgtgttaagtttttgaagtttacagttgtttcaattttgctgctatactttgttaacatattttaggaatatttcattttagtcacaactaggatataaacattattttggtggcgatctccttgtaatcacgacgtcaaccaaatttgggaaattttgatttgttagatttataaattttacagtaacacaaaagtctaatttcctatatattttcaaggcccctatacctttgtcaaaataaagtatcaatgaaaaatgaaaaaatcataaactatgttcaggccaaactgatactgactttgttaaaaggctagatagaaatctgttttcctcttctgttacatctcctcttctggagaccactctgtgtggactgaaggtttgagatcctaggacctaggctagaacagattaggagattgtgctgtatgttaagtggcagataccatggaattctaagcctgttacgaaggaggagaagaagaggcacaatgaccctgacacagcccctgggttgaccacagcagatatctcacttgagcaagtagatatcatctcaattgcttgctgattatctctaacttgtcagtaacttactttgataacctagatttaggagtctgacagcatgcagtgtatgcctcataataatctgctgtttatgaaagtcataacattgtatgtttagcataatggtgaagagcctgccatctggaatggtctacttatttgggatccacatacagtaagctctcacttaacatcatcagtaggttcttggaaactgtgaccttaagcaaaacaacctctaatgaaaccaattttaccacaggctaattgatataaacaagagttaagttcctgtggcatatttctggtcacaaaaacatcactaaacttctaaataaagacccaaaacacttataatattaaccactgaaataaatgtgagctatatatatacatttaagaataataaaaacaaaaaataattatttacccaatttttggtgaaccagtgagtgatagtgatcatagtgatggtggatgaaatcaaggaataaatatttgcaaagtgaaaattgtaagaagcaccccctgtcaccacatagctcagaaataataattagggcaggcttgctgagcatttttaaactgcactgtttattgtcatgcatttgaatgattatcgcagactttatgaattttcattttatattaatttgtaggccaggcacagtggctcacgtctgtaatcccggcactttgggaggccaaggcaggcgggtcactggaggtcaggagttcaacaccagcctgaccaacatggggaatccccatctctactaaaaatacaaaaattagccaggtgtggtggtacacacctgtaatcccagctatttgggaggctgaggcaggagaattgcttgaacctgggaggtggaggttgcagtaagccgagattgtgcccctgcactccggcctggtgacagagctagactctgtctcaaaaaacaataataataatttgtattcattcattttccaatgtgttcattccagttcagggtccagggggcctgcagcttatactcatagctcagagcaactgaccctatagacaggacgccaccccattgtagggtgcactcaaatgcacactcacactcaaactgggacccttcagacatgccagttaccgtatcacacacagcttcgggatgtgggaggaaagcgaagtatctggagaaaaactacacagacatgggaagaacgagccaactctacacagacagtggccctggacagagctgggcaggcatcagttttttttcttttttttgtggggggtgagggtggggcatggagtctcactctgtcacccaggctggattgcagtgcagtggtgtgatctcagctcactacaacctccacctcccgggttcaagagtttctcctgcctcagcctcccaagtagctgggattacaggcgcccgccaccacacctggctaatttttgtatttttagtagagacaaggtttcaccatgttggccaagctggtctggaactcctgacctcaggtgatccacccgccttggcctcccaaagtgatgggattacaggcgtgagctaccgcgcccagtcagcatcattttttttttctcatcaacgttaaaacaatgttgaacaaaacattattcaaagacctgccgtatggctattttctagttgtgtgactttctttgggaaagttagcaaccctttctgagcttaaatgtcctcattcataaaatggggctagtaataatgcataaggtttttgtaagaattagaattaataaagtacttagaccataataactaattagtattagttgttgtctttgctattattttgatgtggtggttgtttggtttcacctgtgtactatcaggacatgctgaaataaaatttaagaattggctttataatattagaaaagcaaacttttgtacgatatgggtatgaaaaattgttgggagtctactttttctctcttacctaatttgtcttagtctttttaaagcttagattttccaaatgagccatagcaaaatataatgtttaaaaatgtttaaattctaagcactatgtcatagttaaataacttaaaggtgctacatcttatacagtccaaaaggaacataattagtaaaattctacaatttagaaaaaaaaatagctgacagtgactgatttataaaagtaaaatatcttttgttaatactaatattctttttataaattaattgatgacaaaaaattgagtgaatgagatttgcagttcatttatctatgatgctggtttatttaatctctataatttgctgtatttgaaagagcatagtgatagaggtcatgataaaatctaggcccagtgccacaactaaatccctgtaggaactctcaaggttttgatttcatctctgaatgggaataacaccttccaagaatattatgaagattaaaaagttacgtatcataaatacacacagagtaacaatactgggaatattgcaacttgtaagaaagaggaagcatatggcatattctgatggttagggatatggactctgtagctgggatgcctgaaagagaactctgactccactaatggctagttatatgaaattgtgcagataatttaacttctctgagtttgcatttttctttgtctatataatggggataataatagtacctacctcacacatagtgttaatttctattagtggttctcattaagatagtattgttgttcatccctggttgttagccatcatgtatctgagttagagagtcattgattttagaaagtcccgaggagactatcaggtcaagcaacctgcctcctgctagacaattagctttatccatgagttaccaaagagggagccgaaacccagggaagctgaaagagctgttgattgtcaccctgtgagttggtgatagaaagatatctggaatcccagtagttgcccatttcctagttctgggctctgcattgcactagaatactgtgccattctaaatatgaaaaggcagtatgaccattgtgcttgtcactttccattccctagatgctatcttatatttgtccttatgaaatttaacctgtgactttcagatcacttagaaccttggttggacagtgttttctagtgttatttagtatatttttttgtcatcttctgttgtctttgggttcccctaaaagagctatactctgggtgccaggaaacttcacacatgactgtcttctcttcctcgacttccctctctacttacctttccagctcgtagcaaatcagaagacttctctgacacctctctatgtctaaaggtcctttgatattctcacatggcggcatgaatcacagtgtattttaactggccttttccttgtatgtctcctacaatgagctgttgaagcttcatgaaaacacaatctgttttactcagggcagttataattccaattacaaagcacatttcctggctcctggctaggaactcgatcatttttcgatgcttccttgctcaggactttctgattccttcttaaaacattttggggcatctccttctcctggtttttggaaacatattctcatactgctatgaaggtttttactgacatttccaacttctcttaaattgattcagcaaatgtttttccataataaatgtcattgatatgtcatcaatatggagagcaacaacagaatgcattgagtaaactcctcccctggaggtctgagaatctagattccagttctcacagagccaccaccttggtgaccttggacagtagaccttctaagcctcagtttccttatcccttaagtggggatattaatagaacccattctcagagatgttgccaagattaaaataaccaagataattcctgtagatgatttggcatagtgcctgccacgtactaagcaagagttagcctccgtcattatagtatgatcataaaaaatgaacagactaaacgaagtaaccagaaggaaagaaattttaattcttaaaatgtaatagtttcttggtttttttttttctgtgaaacacctgcatggcacctttttgttattcatactgttttgactgtggctgtcgtagattcttgttgaaagtctgagagactgagacttgtcattttgaacatggcatcagtggaacagcttatgattcaataattgcatcatcctggacaagcaccagtagaagtgagtcaggacatgtgataaaaagacattcattttgcccctcctccctctctgtattttctttgctataaaattattgatgttaagcccatagtactaatatttcagttcaattcataataaaatttgagggcatttgaatatattatctgttgtaaattataattttatatttgaccacagagtatttgaagtgggtcttttctttccccaaaattctattttaataactaaaaaatattcttaggagaagtattatttaagaacaggtttatattaaataacatcatttcactttcaactttctggtggtcaaaaaatatgctaatactaattaggatatgatacacatgttctgttagaacagttttggcagttagaagacttctcttcttgtgtttgaaagggatgttacttggggtagttatgagccatgtatccagatgtcctgaaaggaccagtggtagatgtatttctatttttgtcttttcttttttctttctggcattctagttgctgagtgactgacttttgttttcagctcttctcacaatcaccattgttctaataactttgcttaaatagaatgtctccttttgctataagccatggggccatttaccgttaattttttaaagtactgaaatgagaacctcataaattaaagaacactcctgattctgagttagcagatcctactaagccttttgcagatggaaatttcctttaaattggtttgttttcctttaacattccattatcctattgttcattctttggagctgtgatttgtttaatatatttcaggcttcttaataaatcaagtcatgtaagttattatttggatcatttcgaaactacaacagcttatcaaacctctgaaagaagaattttgtgtttgcccacagactgaagaactgattcagttttattggctgagctaccttcattattcatatttaattcctggtactgagggtgggaggagggagaggagcagaaaagatacaactattgggtactgggcctaatatctgggtgatgaaataatatgtacaacaagcccccgtgacatgtgtttacctatttaacgaaccctcacatgtatccccaagcctaaaagtttaaaaatatatatttggtaaatcaattgatgtgttttaaaaaatatcgccttttggccgggtgtggtggcccatgtctgtaaccccagcactttgggaggccaagccgggcggatcacgaggtcaggagttcaagaccagcctggccaacatggtgaaaccctgtctctactaaaaatacaaaaaatagctgggcgtggtggcgcgcacctgtaatcccagctactcgggaggctgaggcaggggaatctcttcaacccaggaggcggaggttgcagtgagccaagattgtgccattggactccagcctgggcgacagagcgagactctgtctcaaaaaaaaaaaaaaaaaaaaaaaatcatctttaaagagataactaacccttccccagaaggcagggccaaagtctaaggttcttccaggtcctttgtattccctataaattttagagtcagcctgtcaatttctatacacacacaaaaaaagcctgctgggattatgattggtattgcattgaaattaaatcaatttgggtataagagacttcaatttggggattgagtctatattgagtcttccaatccaggaacactgtatatctctccatttagtcagatatttagtttatttcaacaatattttcagatctttagttcctttcagcaatattttctcatttttcctgtaaagctcttgcacatcttttgtcccatatctattgtgtatatgtgttttgctagttattaaattatattaatataaattttattttccaattgtttgtcgcatatatagaatgttttaaaaatattgtgtcctgtgaccatgctaaattaactaattctagtcattatgtcttcattatctttctcttgaattttcattgtcttccccttctgggactccattcatatgtaaggccatttgatactgtctctcaggtccatgaagttctgttaatttttcttcattcttctttttctctgtgttcttcaactgaatgaatgccattaataatttggtatgtaatggctcacttaaacttccttttgtttttaagatatttctactctcagctgtgtctggaatcctttagtccggagccccaccaaccctcagcctagaaggaaggaggagaaggatagggtgaaaggaaggggagagcttctagcttcaggacagagatcagaacaaacaacagagcagtcatcttggataaggaaacttccctcaaacctattacttatatcctcagaaataagaaaaataatgcatttatcaaattaaaggattttgaaaaagggaacattcagagaataaaactaaactcttgaaagttaaaaggatgataacataaatgaaaagctcagttgaaggattgaaagataaaagtaagaaaatatcccagaaataagagcaaaaagacagcaatgtaaaataggggagaagataagagaattagagaaccagcttaggagttctagaaagagaaaatgtagacaacaaaaggtaagaaatcatcaaagactggagtaggggaggtcatgctatctgtttctttttctattttttattttgagttacatttttttttactgtgaaacaagcatatgtacatgagaatgaacaaaacaaatatgcagtcatgtattgcttaacaacagagataggttctgagaaatgcatcattaggcgatgtcatcattgtgcagacatcatagagtgaacttacacaaatctgaatggtatgtcctacagtacacctggaccatatggtatagctgttgcttccaggccacaaacttacagcatgttactgtactgaacactgcaggcacctctaatacatcggtaagtatttatgtatctaaacatagaaaaggtacaataaaaatacaatataaaagaggaaaaaaatagtacacctgtataggtgcttactgtgaatagggcttccaggattggaagttgctgtgagtcattgagtagtgagtgaatgtgaaggcctaggacatttattatatgaagtctactgtagtgtaaactctgtagacttaggctacactaaatttatagaaaaattttcttcaataataaattaaccttagcctactgtaacttttttactttgtaaacttttaatttttttaacattttgactcctttttagtaacacttagcttaaaacacacacattgtacagctgtaaagaaaattttatgtccttcttctgtaagcttttttccatttttaagatgtttttatttttaaaactgttactaaaaactaatacacaaacacacacattaacctaggcctatacaaagtcagtgtcatcagtgttcaaccttcacatgttatcccactggaaggccttcaggggcaataacaaacacagagctgtcgttttctgtgataacagtgcctttttctgatatacctactgaaagacctggctgagagtgtttgacagttaacaaaaaaaaaaaaggacaagaagtacactctaaaataatgaaaaaagtataatacagtaaatacataaaccaccaacatagtcatttattatcattatcgagtattatgtactgtacacagttgtatttgctgtacttttctataactggtagcacggtaggtttgtttataccagcatcaccacaaacataagcatggtgttgtattacaatgcacagctgcagctaagtgataggactttttcagctccattataattttatgggaccatcactataaatgctgtccatcattgactgaaatttatgtcgtgcatgaccatacatacaatttaatgaaaaataataataataaagctagcagtgtgtaattaccaaccagggcaagaaatagaatattgccaataccttggaggcctccagtatgaccatataagtttacaaatcctattttgttcctcctccccagaggtaaccactgccctgacaaatgtgatcgttgttttcttgtttttcttactacctatataaacatccttaaacaatataactcagtttgtatattttgaattccatgttaatagaatatcatatgtatatgaattttatgtgaatagaatattatatatgtcattttgcatcttgcttttttcattcaacattgtaggattcattcatgttgtagtgtacagctgtcgtttattcattgctgtatagaattatatcctcagagataagatatatggatgtttataaatcattccactattatgaacatttgactagtttgtagtttttatttaaccaaaaaaatgctgctgccaacattcttacacattttactgtatatgcacattaatttatttacaagtataaatttctttttgaatacatatctattgatggagttgctacatcataggacattcttgtctttgactttactggataataccaaactgtcttccaaaatgattacatccttaaactcaggacacatcttattgtcaaatgtttaatttttgtcagtctgatgggtatgtaagttattttattgtcgttttaatttgcatttccctgattactaattaagctgagtaacttttcatatgtttattggccatttggagttcctgtattgtaaagtataagtttttttgtccatttttctagttttctgtccttttagttgaaatccaaatttgcctaaatctgttattctctgagcacaagtaacttgggatgctttcctttagatttagcctaattctttatcattttgtcagcttgatggtgcttttaaggagatatatatgtgtgtgtgcgcacacatgtgcgtgtgtgtatatatatatatgtatatgtatgtatgtattttttgagacagggtctcactctgtcacccaggctggagtgcagcggcacagtcttggctcactgcagcctccacctcctgggttcaagcttttccctgtctcagcaacccgagtagctaggattacaggtatgccaccatacccgctaatttttgtatttaatagaaacagggtttcgccatgttgacaggctggacttgaactcctcacttgaactcctcacgtcaagtgatctgcctgctttagcctcccaaagtgctgggattacaggcatgagctaccgcgcctggcctggatattttttaaaaatattttttatctagcactttggtttttggcaggcaggttggcactcatagtctgacctaccatttctataaaaagaaacctgtaaatgttcttaaacagactttgaaccagtcttcctgattttgaacccctacctttacccccagtttttgagcctttcagaattttttttcataataattaggttgcttcttagctttccccactggtgacttaacagatcttaggaagccaacaatccttgtccatctgctttctgtcttgtgaactgttgctggtattgtctcttctctttattcttagaggtgtatgcttttaaaaacatatactgggtttgagagggagctgaaataaaagcatgtgttaaatataccatctttaaccagaactacatttgactggtcattttattttcaagctcacatacacttcaaacagagatatggctaaaggaattatcatgtgaacaacagccagggctctgaacatcacagattatatcatcatacttgaaatatttgaaattttgattcaaaatgagagctttatagctatgtcctcaatggactaagtgtttaagtacttaacatccaaaacattcttactaatcaagagaagacaaacaccccaacagagaaataggcaaattttatcaatagccagttcaccagatttgttttctgttagaagcgaatatggggaaatacatgtgtccatgttttgcctacttttcctggagcaggtaaggagaggcagtttaaggatccatgtgataaaccctaaagttgtccatcggctttccagtcccttctaggaatttaacttagggaaataatcagacatttgcaaaggtgtgtacagtggtatttataatagtgaaaaaccaaagaatgaccaataacgggagaatggaagttacagccaaatactttacaactactaaagaatcatgtaaaatatctattgacataggagttttatcaaaatgtgaagtatacagatgaatagtaccacacataaaaagcaaggtgcaaattagccatttatattgttatccccaaaataaatagatgcagtttttttaaaagatgcaggctatatatggaagtgtttgctggttttctgtcaaaagaatggcgactttattttctaatttaaactttttgctgttttctaaattgtctaaatagttatagtttttataatgtaaaagtatcttccaatttagcttcatttgacaaattaccttttcattctatctagctatgtaattctaaatgaatttacagcagtaatcttagagcagatgaatttacaacaataatcttagagtagactacggattagatgtaaaaacatgagttgggctttatggttacagagagttttcctcagtgtggggatcatagctgtattgagtttattcagttttcctttcccacatgaatgaaaaatggggccagcctacaactggaagggcctcggcatgtaccactgtactgtgtatgatgtgatttcttgatgctagtagggagagaatcaaattgcctcctattcaaaccaagacccacaaatagcgtcaaccagtcatttcagctactccctgcagtgtcaagaaggtgtgaacccctcatgttctctattgcatacccttgtctaattcagtgtttcttcttcttttcaggttttggctttatgctacatttcagaaatcataataaccttttctggtattattttattctttttcgcactgtgagaaaaattaaactttcaagtggatgcttcttataaactatttatacccttttgctcccttttgggaggcagggacagggacagagttcctcctcaggctaactaagaaaacttactgcttccaatgtaatttaaaagatctccctctttctattgctctctgtactcttaattcttttttttttttttcacagcagagacaagtgaacatttatttttatgcctttcttcctatgtgtatttcaagtctttatcaaaacaaggccccaggactctccagattcaattatgtccttgggcttggtcgactgctgtaggagtctcagggagccttctacaaatgctagagtgactcatttaccaacattaaaccctaggatacatgcaacaaagcaggactccttcctccatggaatgtgccgatttcagatgacacagcacccaatgtagaaaacgctggaatttttccttggaactagactgtgatgagaggtgcttgacatgaacataagctactgtcttttctttttttttgagacagagtttcgcttgttgcccaggctggagtgcaatggcgtgatctcagctcactgcaacttccacctcccaggttcaagcgattctcctgcctcagcctcctgagtagctgggattacaggcacgtgccaccatgcccggctaatttttgtatttttagtagagatggcatttctccatgttggtcaggctggtctcgaactcccaacctcaggtgatctgcctgcctcagcctcccaaagtgttgggattacaggcatgagccaccacgaccggccagctactgtcttttctttgacccttcctttccagtttttgaagataaagcaggaaataatcttctctgaagatacttgataaaaattcccaaaacaacaaaacgcatgcttccacttcactgataaaaaatttaccgcagtttgtcacctaagagtatgacaacagcaataaaaagtaatttcaaaaagttaagatttcttcagcaaaatagatgattcacatcttcaagtcctttttgaaatcagttattaatattattctttccccatttccatctgaatgactgcagcaatagttttttgtttgtttgtttgtttgtttgtttgttttttgagatggagtctcgctctgtcgcccagctggagtgcactggcgcaatcttggctcactgcagtctctgcctcctgggttcaagcgattttcctgccttagcctctcgagtagctgggactacaggcacgtgccaccacacccagctcatttttgtatttttagtagagacagggtttcaccatgttggccaggatggtctcaatctcctgacctcatggtctgcccgccttggcctcccaaagtgctgggattacaggcgtgagccaccgcgcccggccagcaatacagtttttagttactcgacatctttaagcctataactcttaggctatgcatagccccatgtcctaatcaggcattcactgatcccagcaggtctccatctatttgtaccagcctcctctttcctcccaatctcaaggttactcttaaatactagtaaatgcaaaaagaacttgtaaagtggcaaggcatggcctatcaaaagtcagcccaagggcagttttcagccctgcctcacctgggtctagttcagctgacggatgagctgattgatgcgttcaccccgatagccaggtgtgcccatctccttgaggaagcccactctatttttggtagcatgatgggccactgagaggtggaaagggcgcaagaaccatgagatctcctggaaatgcttccctgggaaggcaatttcatgaatgaggtcttccaagcaaatgaagccaaacttccccaggtgctcctcaatcactgtgttgtctgtcagagggatggtcttattcttgaccttggcttgtccacgtttcaaaatgagttctcggacagacttcagatttggaaatccccaggtcacataaggttccactatatgcagcatttttagattctagggggtaacttttacaaagataccactaaaaattttctttaggcgaagtcttgcagtggttctctgcacccgtaaactcacgccatcaatcctttcgatgcgtacaacaaaggccaaggaatgtttatctggcaattccaaggcatgaggtttcacttctagtcgtctgagacgcaccttgtcacgtttctgccgccaggaatcatgtaggaatgattccagtcgcttaaacctgagcccttttcctttcttctgtcttgctactgccatctttctagtggtgcagctactcaattctttttttaattataatttttattttaagttccagggtacatgtgcaggatgtgcaggttacataggtaaacatgtggccatggtggtttgctgtacctatcaactcatcaggtattaagcccggcatgcgttagctatttttcctaatgctgtcccgcccccccacccaacgggccccagttacactcttaatccttatagctcagatgttatgatccacagtgtggttcttacagaaagttatggattaaaaaaaaaaaaaaacactcaaagtgcccgaactttcttaaaataatcctggtacagctaaactcatgcactgactgtccacctaatatttaacagtctgtgttgtgatatattgttttaatgttctgaatgcttgtcagctttcagtattgaagatgtgaatcatttatcagcaatgacacatttagtctaaggttgtcagctatttatgctacaaattaatgacttgtccttaaaatatcaattttgtgattcatgttttggcaggtggttagatgttttgtgttctaattttaaactatggataaaggttttgtcataatcattgttttattggttccttttctcccctgcccactccccaaaaaaccctgcaattcttttttgttaaacttttattttaggttcagaggtacatgtgcaggtttgttatataggcaaattttgtgccacaggggtttgctgtacagattatttcatcacccaggaaataaacacagtacttgatggataggtttttagtcttcattctcttcccaccctcaagtaggccccagtgtctgtccttcccttctttgtgtccctgtgtactcaatgtttagttcctagttataactgagaagaacatgtggtatttggttttctattcctgtgttagtttgcttaggataatggctgccagctccatccatgttgccgcaaaggacatgatttcattctttttatcgctgtgtagaattccatggtgtatatgtaccacattttctttatgcagtcttctgttgatgggcttttaggttgattctatgtctttgctattgtgagtagtactgcagtgaacatacacatgcatgcgtctttatggtagaatcatttatattcctctgggtatatacccagtgatgggattgctgggtcgaatggtagttctgttttaagttctttgagaaatcatcaaactgctttccacaatggctggattaatttacacttccaccaggagtgtataagcatttccctttctctgcaacctcaccaggatctattattttctgactttttaataatagctgttctgactggtgtgagatggtatcccagcaccatttattgaatagggagtcctttccccattacttgtttttgttgactttgttgaagattggatggttttaagtgtgtggtcttatttctgggctctattctgttgcattggtctatgtgtctgttttgtaccaataccatgctgttttggttactttagccttgtagtagtttgaagtcgggtaatacggtgcctccagctttgttcttttggcttaggattgctttggctatttgtgcccttttttgattctatatgaattttaaaatagtttttttctaattctgtgatgaatgtcattggtattttgagagcaatagcactgaacccgctaattgctttgggcagtatggcgattttaacaatatcgattctttctatcccctgcaattctttgttgttgtatttaactatttttacttgtgaagttttttcagggatgattttgttgaaagtgacaactctaaaaattatgttggtaattaaaattttaagtaatgacttttattttcagagattccacttctcttagactttggagctgttaacagcagtgtccaatctgcagtggtactcagcagtttctgtttcctgcatgcagaactgcttatatgaaaacacagttttaaaaatgctttcttatggctgacattcacattcttattccttttgattcttttcaagagggatttggtttgttaaaattaatttttgcaatacttttatgaagatacaaactctgacaaagcttttaaaacaagtttgagagaatacagtattgatttcacttgtaaatctgacgattattttagaaaaaaggaaaatattatttactattattttgcttataaatgtttatcaattttaaagcttccacattgcacatctcccactacaacagtagctaccatttattctttctcaaaaaaagtgctaagtgtgcccttgaaatttttacattgtgcagaatatccctaaaattttaaaacaaaaattacatcatcacttgctttaaatgtttcttctttatttaacatacagtttctaaaatgttagcaaatagcattttagaagagacacgttacttttctaatgaatgttctaaaatgaaccacagtaacctatacttacttagactgtgaaaaacaaaacttatattctattgttaaattttcaaaagtgaaactacacgatagtttacttggcacatcactctgttattgtgaattgacaaatgtatatgtagacaaatatgtgaaaatcagagtacatatacattatatgcagcaccacaatacattttttagtatgttttgactgatatttaattatataatttaccaagaggatctcaccagaatgtagaaaagtattgaattttagaacaattcacatatttaaaaaaaatgtagtcagcccttttatctgtatctggagaatgcagggtaaaggaataatacatgagtattggtatttaaaaaaaggtgttaatttcttacctatgatacctgttactttgggtatcatttaacctttatttctgtgaaatagaggagttctaacatcctctaattattataatattgttctaatttaatctatcttaatctgtgatacagtttgaaaaccaagcttttactattggcatgtgcaaaaaaataaagcagcagtagacttggaatcttgaatgcaaatttagattttgcctcttaataaatgtataatatagtgttctgggaccaattctctaacatttctgagtcctagtttctgcatctgtcaaatgggattagagatacctactttcaggatgtgatatggtttggctctgtgtccccacccaaatcttatcttgaattgtaatccccatatattgagggagggacctggtgtgaggtgtttggatcatggaagtgatttcctccatgctgttctcgtgatagtgtgggagatcgcaaaacatctgatggtttaaatatggcagtttcccctgtgctttctctctctcctgccaccatgtaagactttccttgcttcctctttgccttctgccatgattgtatgtttcttgaggcctccccagctatgcagaactatgagtaaattaaacctcccttataaattacccagtctcagatattctttatagtagtgtaaaaactgactaatacagagaattggtactggcagggttgggtactgctataaagataatctgaaaatgcggaagtgactttggaactgggtaacaggcagtggttagaacagtttggagggctcagaagaaaactggaagatataggaaagtttggaacgtcctagagacttgttttgaatacttttgaccaaaatgctgatagtgacgtggacaatgaagtccaggctgaaatggtcccagagatgaggaacttattgggaactggagcaaaggttatttttgctatgctttagcaaaaagactggcagcattttacccctgccctagagaactgatgaactttgagatgatttagggtatttggcagaagaaaatttctaagcagcaaagcatcctagtggtgacttggctgattctgaaagcgttcagtcatgtgcattcacgaagatatggtctgaaattggaacttaggtttagaagtgaagcagaacataaaggtttggaaaatttgcagcctgaccatgtagtagaaaagaaaaccccattttctggggaggaattcaagccagctgcagaaatctgaataagtaacaaggagtaataagtaataataagtaaaaagtaataagtaataagtaacaaggagccaaatgttaataaccaagacaatggagaaaatgtctccagggcatggcagagatcttcggggcagcccctcccatcacaggcctgagaactaggagggaaaaatggtttcctgctcagggccttgctgctctgtacagcctcacgacatggtgccctgcatccctgatgctccagctccagctgtggctgtaaggggccaagttacagctcgcaccattgcttcagagggtgcaagccccaagctttggcagctttcacgtggtgttgggcctgcaggtgcgcagaagacaagagttgaggtttgggaacctgtgcctatatttaagaggatgtatagaaacgcctggatgtccaggcagaagtctgccatggaggcagagccttcatggagaacctctgctagggcaatgcggaagggaaatatggggttggatccctcatacagagtccccactggggcactacctagtggagctgtgagaagagggcctctgtcctccaggccccagaaaggtagattcaccgacagtttgcagtatacgtctggaaaagccacagaatgccagcctgtgaaagccacaggggtaccctgctgagccacaggggcggagctgcccaagggtatgaaagcccaccccttacttcagtgtgccctgaatgtgagacatggagtcaaaggagattttggagcttttagatttaagggctgcccagctgggtttcagatttcatggggcctgtggcccttggtttgaccagtttctcccatttggaacaggaacatttacccaatgcctgttccctcattgtatcttggaagtaactaacttgcttttgattttataggctcatacgtggaagggacttgccatgtctcagatgagactttggtcttggacttttgagttaatgctgtaataagactttgggggactgttgtgaaggcataattggttttaaaatgtaaaaagacatgggatttgagagggagcaagtgcaaaataatatggtttggctctgtgtccccacccaaatctaatcttgaattgtaacccgcatgttttgggggagggacctggtgggaggcagttggatcatgggggggttttttccatgctgttcttgtgatagggagttctcaggagagttgatggtttaaatgtggcagtttcccttgtgctctttctctctcctgctgccaggtgagacgtgtcttgcttcccctgccccttccaccatgatcataagtttcctgaggcctccccagccatgcagaactgtgagtcaattaaacctcctttccgtataaattacccagtctcagatagtatctttatagcagtgtcagaatggactaatacaggatagtaatgaagattacagaatatgtagatgaagaagtgctaagtaaatagcagctattattatgtagtcaaattgaatgtatacattgtggtacttcagtgtcctttaaattgaataactagaaatttgttggctttctcaatctgctcacatcagatgacatgttaatttatgcctatacttttttctagttaatagatataaatctattcactcaacttctattgacagaactggtagtgtggcaagacatctcatttctagttaaggctgtataatattaagttcattttacttaaattaactatggtttgggaaatgcttttcatgtcatcatgtatgcccaatttgatactttagtgggacagtatatttcagaaaaaaacaaatgcttccccaaaaattccagggttgaatacattagtcagacatataacaatgtacttcagagttcctctaagggcaaaaatcgtggtatgaatatacaaaacactcctatttatacttttgtatttttgaaatgtagtcttcatgttaatttagcatttcaatgaccagcatgacattatcttaataatttggaatgccaatatgttcatttaagacttaatatagtaagtatctaaagaaaaaaatggaagtgactgaatgcttttgtatctcttaattataatttgtgctccattgtgatatgaaggatagaaggggcaggatagatagaaaacagaaattaactttgatgtttaaccttaccttaagactgtctgttaagtgacccacataatcttaaaaaactctgtcaagcttaatggatgctactctgcaggcccctgccaggcaacagtcacaaggttatgaggtgcatagattttggaattaggcagagctgaattcagatccaggtgttgccttataatgcgactttgggcaaataaaaggcccaatttttgtattcttatctgtaaaatggactcagtaaaaattatttgagataatttatttgtgtactgtacctaggcatgcagcttgacacacagaattacaagtcagtagtttccagtatgattattattgtgaaagagatattttgtttcacctactgaaaacttttttcagtcttaaattttttatctaactggctgtattgcagatgtctgctatataacttttatataattttaaaaactatttctttcctccttgatcttctaggggtaaggttaccaatgttttcattatttactaaatatagcagcccccaccccttattcatggaggataggttccaaaacccctagtgtatgcttgaaaccacagaccacagataatcccaaatcctatatgtatattgtttttcctatacatacatacctatggttaatgtttaacctactaattaggaagagtaaaagagtaatagtaactaataataaaataaaacaattgtaacaatattccagcatcactattcttgtgctttagggccaccattaagtaaaataagggttacttgaacacaagcactgtgatactgtggcagtccaactggtaacagagatagtgatgcggtttggctgtgtcctcaccagaatctcaacgtgaattgtatctcccagaattcctatgtgttgtgggagggacccagggggagctaattgaatcacagggtctggtctttcccttgctattctcgtgatagttaataagtctcacatgatctgatgggtttatcaggggtttccccttttgcctcttcctcatttttcttttgccaccaccatgtaagaagtaccttttgcctcccgccatgattctgaggcctccccagccctgtggaactctaagtccaattaaacctctttttgttcccagttttgggtgtgtctttatcacaagcatgaaaatggactaatacagtaaattggtaccagtagagtgggtgttgctgaaaagatacccaaaaatgtggaagcgactttggaactttggaggactcagaagaagacgggaaaatgtgggaaagttaggaacctcctagagacatgttgaatggctttgaccaacatgctgatagtgatatgaacaataagatccaggctgaggtggtctcagatggatattaggaactttttgggaactggagcaaaggttactatgttatgttttagcaaaaagactggcagcattttgcctctgccctagagatttgtggaactttgaacttgagagagatgatttagggtatctggtggaagaaatttctaagcagcaaagcactcaaaaggtgacttcggtgctgttaaaagcattctgttttaaaagggaaacagcataaaacttcagaaaatttgcagcctgacaatgcagttgaaaagagaaacccattttttgagaagaaattaaagctggctgcagatatttgcataagtagcaaggagcctaatgttaatccccaagaccatggggaaaatgtctccatggccatgtcagagaccttcacagcagcccttcccatcacaggcccagagacccaggaggaaaaagtggtttcgtgggccaggcccacggtcctcatgctatgtgtaggctagggactttgtgccctgtgtcccagctgctccagctgtggctgaaaggagccaatatagagctcaggctgtgacttcagagggtggaggccccaagccttggcagcttccacatggtgctgagcctgtgggtacacagaagtcaagaattgaggtttgggaacctctgcctagattttagaagacgtatggaaacacctagatgcccaggcagaagtattactgcagggcagggctgtcatggagaacctttgctagggcagtgcagaagggaaatgtgggattggagccctcacacagaatccctactggggcactgcccagtggagctgtgggaagagagccgtcatcctccagaccccagaatggtagatccaccaacaacttgcaccatgtacctggaaaagccacagacactcaatgccagcctgtgaaagcagccgggaggtaggctgcaaagtcacaggggcggagctgcccaagaccatgggaatccatcttttgcatcagcatgacctggatatgagacctggagtcaaaggagatcattttggggctttaaaatttgactaactcactggatttcagacttgcatgggccccgtaacccctttgttttggccaatttctcccatttggaacagctgtatttaacctgtgacacccccctaccccctgccccccatccctccggcccttgtatctggaagtaactagcttgcttttgattttataggctcataggcagaagagacttactagccttgtctcagatgagactttggactgtggacttctgggttaatactgaaataagctaagactttgggggactattgggaaggcatgattggttttgaaatgtgaggacatgagatttggaggggccaggggtggaatgatatggtttggctgtgtccccaccctaatctcaacttgaattgtatgtcccagaattcccatgtgttgtgggagggacccgggggtgggggtgcagtaattgaatcatgggggctggtctttcctgtgctattctcatgatagtgaataagactgacgagatctcatgggtttatcaggggtttccaaaacttttgcctcttcctcatttttctcttgccaccaccatgtaagaagtacctttcacctcctgccatgattctgaggcttccccagccatgtggaactgtaagtccaattaaacctctttttcttcccagttttaggtatatctttatcagcagtgtgaaaacaactaatacagatggctagtaagggactaaccggcagggagcgtctccagtgtggatatgctggacaaagggatgattcacgttccagggcataagatttcattactcagaattgcacagaatttaaaacttattaattatttctggaattttccacttaatgttttcaaactgtggttgactgcaggtacctgaaactgtcaaaagtgaaaccacagataagtggggagtcctgtacctaagattattcctttaaattgtttcagtggatatgtagggacctgagtgtgaagtgagagcagcagcatcaaaacctgagggaaatccagatagcaaaagaaacttgtctagtatactggcatgacagagaaaccaaaaagttctcaagttaatgtgagaatctaagaattaaagaattaagcctttgcctttgagggaaggaaaggggtaatgtggctttaaatcaggttgagattggttctgagggttccttttccttcctttatattgatatgaatatagacacaactgttctgcatttccatttgtttttataaatgtctttttaggatttaggaactgctaattatgcaatatgagatatctgttagtttgaggaacatttgaaaatttggtcaaatgacacagatcgtcacacagttttaagacaaatgtttttacctatttgacctagtctggcaatccctatttgggcaaaaatcttcatttgcaggtcatgattggaggcaggcacagaaaaaaaattgccaccttttttgcattatgtcatcaagacatcaaacttcagcctacaaagtagaaagtgttatttctcaagttgaaggcctggatatacctcagcttctcagttctgacactttatcatagtggaaaatgaagaagattgcttaagaacactgatgttggtgtcagaaagacctgggtttgaaccctgactttactagttacttagatcactttaggcaactcaacttttctaaatcttgtttcttcatctgtaaatgctgaaaatagtacccacctcttaggtctgtggagaggattaaatgagataatctatacaaagaaagagcttgcataatagtgccaagtaatggtgaggttatacctgtattctgattataatctcataaatatttaccatgttagctgtctcagagttcttttgcaaaacagataaagatagaaagtataaataagaaaaataagtgaacatatactgaactttgtacaagatgctggcgatatggagagacccaagacatgggccctacctaaaagagattattgatagaaacaggatacatatacatcaaaaggtaacataggatcatctgtgcaaagtgctatatggcagtgttttaggaagtctagaagctgtcatggatcaggaataccatggtggacacttcaggcagggaaaacagatcttagcaaaagctactcctatcataggtacttgataaatatttgtagaatccaggatccctgtagtgataaagaaactacatggattatgtaggggagtgataagacatatgactggaaaaataaaaagaccaaattatggaccatactgagcttgtactataaacagtggaggagcccttcagatttttaatcatgttgagaaaagagttttagcagtgtgtgggggatagaatggaaagagaagccagtgccagaaggactacttagtatcaaccattgcagtggttaaagcaagaggtgagagaaggcatgcattagaatggcagcggtcagagtggatgggaaggaataggtcctgacatagtgttacagggagtaataaataggatgtggaagatgggttagaattggcaaaatctctgcatgtaagtctgggttactaaatatagtgagagaaattcaaatctctctttaagaatcgaataaaatatttagaaataagttactgttgtatttgaggtgaacacaaatggcatttcaaagatgctcgagataccttgttggaaaaagtcaataactgcactattgtctccaacatgttcttgccttctctgaagacatcatgttcctaattctgaattatgaaccatctattatccttgtatgctcttatgtgtgaggaaccataaggtgggaacaaaatccggtcttcattctagaaataactatgcgatcaaaaagtttttagtctttcttcttaccatactggttcttggtattctgtttaccattcaatgtactattattgcttctgcttaaaactcgcatcccctaatgcaagcctgagcaaacagaactgataacacacagcctgagaagggagtgcttggggtctcaagacttattctgtttttctccatctttgacacttggtttgaagagcaaagaaggatacagctgttaggaagtaagttacccaaacacagtgaccaaactggattaattcttccaatgagaaagaaatacattatttctgtgagacagattagactttaagtagcatagataacatgattatattctctctacaaataaatacacaggacctaagaaaccctttacagatccaagtgttttcctctccacttttccatccccaaacccatcttgcaagatatggccagcttatttggagttaattaaatcaagaccttcgttttacagacagggaaaccaagcccagagacactgagtagtaggccactggtgtcttagaggtctgaaaaatcctttactgaacattctcttgatctattaatgtataggttttgttgctgtaaccctctccccaagaggagtgaatataaatgatgcagagtttggatgaactatcttaataagaacctaaagttgaaaccaatgcaaacctctctcaataaatgcaaagcaaagagaataatcagtctttctttggcttgttaaataagataaaatgtgttctgctaaaaccatttaacagaaatattgtgaaaggtttcccctaaagcatttttctatttgatttgaaaactattccatagcttattatcaaacaaatcagtaattctttagctaatgcagagataaatgggcagtcagaaaatataatcacctggtgtgtgcagctgagtatttacatttttcctaatgaacaaagataagaaaagtgcaggtgactttaatgtgtaaaaactaccttttagtgctagcgctagagggaaaaagaaattactggctcaagccaatcctgtacttgataactaagccgtatagtccatggcttggcttcagttctgttttgaatctctttttggacttgtcttgaatggactgtttagggctgcttcagtagtgcagttgttgcatttttaagcatagtttaggttttaaaatgtttctggtccctttttttttttcttttccactttatgttgcttaaagctttatggccaggttttctcatcctcagcattattgacatttgaagctggatacttctttgtggtgggggctgtcctgtgccttgtaggctggttagcagcatccctcgcctcttctcacttagatgccaatagcatttccccaaccgtgataaccaaaagtgttttcagacactgccaaatgtctcctagagagcaaaattgctctctgttgagaactactgtgttacggtgtttggacaaaaactgacaagccaatgggaatattctattggtagttgtaaaaaattaatccagttatagcagctgtatttctggaatttttttccatattaacacttgctttctgaggtgataatatctttgttttttttctcccaaatagatttcttgcattacactgaaaaattgctgattaattcacttaaattgaagactaagccaatcatgtcatttgggtaatagtttaccaactctgcccctttctctgtcagggaagcctctaatttagtaagcgatactgtatccttttgtcaggtacattaccattcctattagcaatagggcaattgagattgagaaagattaaaaggtcaccaagctattacattgtagaattaggttatgaattgtagcctatctggtttagaatctttaccttactagtctccataacaacaattcttccagtgtggtccatggggccctgggagtctccccttaaagggcagactattttcacagtaacacgtactttatttgccatttcattatgtcagcatttgcaataatggtacaaaagcaaagatgagtaaaactgttggcatcttagtatacagtagttactgtattcactgtcatgcacttaaaatctttgaagaagcaaaaaaattattaattacattaaatttcaacccttaaatacatgtggtctttctcatgtcagtgtgacaaaatgagaaggtgcataatccacttatatcgcatatagcatttgatagttgtctcaaagaaaagtgtataagattaaactgtgagttaacctactttttttcatggagtaccatgagagataaactctggttttcagccttgggtatttggcgatgttttcccaaaaatgactgaagtaaacttagcactttaaggaaaacaacttaaagtatttgttgccaattgataaaatataggtttcaagcaaaaatcagaatttttgaagacttgtatctgccactgtgagcttgacaaatgtgactcttttatattacataatgaactatgtcaacatttgaaagatctgcataactcagtgaaccagtattttccagatgactaatgcatgataatacaaaatcatgcatgggtaaaagatacattcaaagtgcaagatagactgacatatttcaatgtaacaatcaaaagttcattgataacagttttggattccacattgcaatactaaaacctttaaaaaacgaaattgtccaattttggtgtagtaatcagaaaaggcaatctataattacctgaacttaagtttctggaggaccattaaccttctacaggctcatggggaagactgtagcacttctctttccctaagatcctccagaaaggaagaaggtaatccttgggggtagggtagagacctattgtgtgatgatcaccaagtatgtaacaatgctttatataactctaatatatataatccacacaaaccccctaaaatggcactaataagggaatggactcaaagaagttaagtcagctagccactgtcacagctattagagcactggaactaggatttgaacccagatttgtctgtatgtaaagctgattctcttcgtaatagtactgagacacaagaggcggctacaaaatattctggtactccatcctagaccagagtttcaaggttcgttatcatttgtagcatgatactggatcctcacagtgcttgcctttcattcaggtgccaggaaacgtctgcctgaatgaatgggtgtaatttacctgcacattttacatgcttctctaggtgtgtgattaactcataatccatccatgactttcacccataatcctccttgtagcaattgctttgcttgcaacaaaactaagtagacatatctagctttatgcatggttttctctctctgaactctaacataaactcagcctcaggaattattcggtttctactacatttgccattctgattgggaaccaccagcattcaggtattcacctggaacaaggcattttgttccaagggttcctcacttaaaagcaagcaccctagcaatagttcataatggaacttcttaacattctcagaatgtttggcacagctgtgagtgaacacacattgagcaatcaataactattacagataatgatgcccttaagaccaggatattttagctttcccattcaaagggggtgaaatatgcactcttactatggtatacttttggttccttctgccatgtatccttaataaaagatgtcaattccatatggttttctcttgagttctaaccattttgttgtaccctagcccttttaacaatatcaaacttgcaactgaataccatttagcattcatccattttttccaatggtgttcattataggctatcttactcctcctatttgtatgacaaaaattggcttttttcaccgatgtctatggtacatctggcagctttccatgtactcagttcttatctgatgtagcccagaacgactgcctgaagggatgccaaaagcctgattgaggttccaaattttcagctactgtactatcaatccatttgttcatttttactttcccttgtcatctgtagcttacagttgagtggcctgaacatgttttgcatacattgtaatatctaagaatttgggaatacggtcctaggatttagacttaatactaccttccatttatataatacttactcataaaatcttcagtgttcctgaaaaagaaaaaggaacatgtattgagtgcctgctagaagcaggaacttgtagtagattttctatgtgttaccttattttcacaacacacacacaggtgatatccttcccagtttactgatgaggaaactcaggggtcaaagtagtagatacctacccaaggtaacagaagctgtgaagtggtacagctgggatctaaaatatgtcagcttcaccgtagataggctccctgatgaaccacctgccacggcccgtatgaccgcatccaggggtgatgatgtcattttcacagggttattgagagctaaaactacgaagtactacaaactattatttaaaatataaatacatactatatatgcatatgtgtgtatatataattaatggggtaaacattacagaatactgtcctaacctttaaacaatgcactcgttttctgtaaactaatatacaaacaactgtttggtccctaaaaatagatgtcaggtgacagagactggctgagcaagaataggagtatcttcagaatagaagccagaggagtttttgcttccccaacacattgtcgcaccattcactgttccaggaccttcctacttctctggaaaactctggcccaaagcagctcctctacattagtcacaagtttccattaatcaggggtggcctgtgccggacctacagcagagtcatttcaggttattctgttacaggctttcgacgtgtagtcagtccactcgcccaaatctagcagggaatgaatgccttgtaatacggaagcatctacaaattcttcttaacagtgttcagagaacaatgtgaaaccctggggccttttcccagaattagggtggtgggaatgctgtcctattgactaagcctgttaggtaagcaggcagttggcaagattcaggaagcttcatttgaagatagaatttagggcgatcgtttggatttactggcttaattacttaaggtaacatttataaaagaaattgtcattccattattattaccttttaacttttattcctaaacggaacattagcaacaaactacattacttgataaatgtaatttctaaccagattgataactagaaaaaaattttaagttactttgctctgtgaattagtttaaacatatttgtaattgagacttactactgttattggctgaaataaataaaagcaagagataataaagaataacagagacaacgaacacccaatttaagtttatttctaagttccatcttttttagagaaaaggcaaattaagaaaagtttagagagaggtactagtatatttatgaacttgtatagatgataagcaaaacggactttaatatgtagaattccagaatcaacaggttgccagcatccatgtttttgaagatttgcttaagaacacaaccaaaaatggaatgggcagtctctaattacaagcagaaggctacaaaatcattttagctgcataatacagttttggttctaaagtcagcacgtaagaggaaaattccttaggaaaatacaacattgaaaaccattgtgtcatgtaatatgaaatgcaataattaatttttcctccagtaatagaaagatcactgtttcattggtttataaaaatatatctttatcattaaatgtggcaaaatgttaagacttggtgaatattggtgaaaagtatatatccattgtacaattctttccaattttttttgagattgaaaatttttaaaacaacaaattatcttttaaacagctaataatcactagacctgcactctttgtggtgagactatgaaaaatgttagagacctagtaagagaagcagattcacatttctgtcttcttcttcaagccaaacagtcatagagtggagtgggcagaatggaactcacttttgaaagcctagtgctttgtccaatcttactgcaagccagacaggaaggttatagaaaatgtttctggatcagtcttctctgagtcatatgaaattgtggtttcagccaagatgacattaggaattagagacatgggacaaaaactttaagattgtaaaaaaattttgactctagtaggaaacatgggtagaattgtaatgacacttgattgaattttaaaagatgcctgtataagatcttaaaattaggaaaaaaattatggcctaagcaattaaaggcataggaggcatctttttgggatgatggaaatatcctctctcctgattgtgatagtagttacatgaatattcatttaacaaaaaccataaattatagacttagaaaacagtaaatgttactgtatgtgacaccttaataaacgtgattataaaaataaatcctaagcatctaaaaaaaaaaaaaaaaagaagaagaagtgaaccagaaccacaccattctattttggagacacttcaaaagaaatgacctcattcttaattttgtttaaagaagaatataacatgatttgaatatatttagctaggatattttagtgcctgctagcacttgaagccagagttcactgtgagcattctgactatgaagtgagaagctaagagaactgtattttgatattcctttgacagttaaatcataacactgttcttccccttctttagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagtgtgtgttttgaagagtttatttttcctctacttggttttcatttctcagggtggattttgaaatttccattatatgcaaagcccatgaaaggctaaatatcagttaagaggggagaggagggtggctcctaggtcctctaatgggcaggaaagtatttaaaacaacaatacaaaaagatctagaataaaatagaaaagtacaagttgatgtctgggagtttggtcagggagcataaggtaacactataagaaagtgctatcatatgaaatgatggtgttaagtttgggcataacataatgttcattgtattagaaacatgggctttaacttccataagctaataggtttcaaagtcaccaactttactggcctggcaaaaatgagtcacagtgagaactgtgacaggaaaaaaaaaagatattcatttcatttcttattcattttttttttctattaagccagggcactgtgctaagtggtataaataccaataagacctgatccttaccctctgggaagtcacactccactgaagtgaaagatgagttaacaatgacaaggtacagagattataatatagatgagggagagagaaactcggcctgaggaggtcaggaaaggtattttagagaaactgatttcactatataaatgttgtattaacacaaatcttactttgttatggattcagactgctgacagggcaacagcattatctccctaaagaatgagaaattcattccatagcaaatttattagaagagagtctaaaatgtcctaatactaccagtgactcctctaggaaaaaaattgtcatataatttagttatttctaaagcagtttgaaagtagcttggcctaaagctctgattatattaattttttaaagaaacaattattcattcactgtatgaggattattattatttgtctcatgttgtgtttgcatatccatgagagttagatgagtcattttcttttgttttactttttaatacattagcaaattataaaattactcatattacaccacaaagattacaaggatggcagctttggccagtgtagtagtcccacctattgattagagtcaaaagtaaagcccagccctgctttgtgcattgctcctaataaagtggatgttacttaacacatacgcagaagacagaagcgtcttcgtgtcctcactttactcctcactttcttaactgcttaagtatttccacgatataaatgcagtgataataataatacggacagtccctgacttaacgatttttcaacttttatgatggtgggaaagtgatacgcattcagtatggctcctcgacttacaatggggttgcctccagataaacccattgtgaattgaaaatatcttacacttagcactccattcttaatacctgctagaattatagattatccctcaaaattggcatagtataatatgggtatcagcaagttgttgcactttattcagagctttacactaggcaggggtgggctttacttttgactctaatcaataggtgggactactacactagccaaagctggcatccttgtggtctctgtggagtaacgtgagtagcattataatttacatcccccataacaaatgatccaagagagtatgtgatcaatgcagcagaactattgtcttttattatctgatttcacatgtaacatgccatcacttctgccatattttattggccacacagaccaatcttggtaaaggacggaaagggactgcacaagaccatgcattcaaggaggcagagatcactgggggccatcttgggaggctggctaccacacccaccataaatagaaaaccagaattatttgccaaaaatagactttaaccacaaaaatgaataccatataaacaaaacaaagtcacaaaatttcagctgacttgaagactcatctttctattagttagaaagggaatttaccaagtagtagaagacacaggaactccaaaataagatatctcattgtcttatcagaagggttgacaggaaaatgggctgggcactgtggctcaaggaaaatgggctgtgcactgtggctcacacctattatcccagcaatttgggaggccaagatgggaggattgcttgaggcctggagtttgagaccagcctgagcaacataacgagaccccgtctctacaggaaaaaaaaaaaaaaaaaaaacgttatccaggcatcgcacctgtagtctcagctactcaggaagctaaagcaggagattcaggctgcaaagagctatgacacaccactgtactccagcctaggcaacgtagcaagaacttgtctaaaaataaataaataaatgagtcaaggaatgaatgaatggattgacaggaaatgactattagttgtacgtggccatgtgttatgaaatagtgaatactagttaaaactcctcattttatagataaggaacagatagatagacttgtccaacttcatgctaataaccacaaagggctatttttaacttatgaaggtacattgcctctgatcctatagctcagagtcttagctgtgcacaagacatacctgggataaagaaatcaagattggcgtaatgtgcacatcctgacatttcagttggatataaacaaaactttggaatttttcatttttagcagtgggtgattttttttctttttttcttccagtaactgtaggacagtgatttagagattccttatagggtataacttttttgtattataaccacttcatcaatagatgtatctgttgatcgtacttttgatttataggggatagaattgggttagtgcttccattttctgtccaagtaaagaagctaggatatttatagagtacaaaaagaaattgaaacagctggtacagatatttggcattggagagcagctctgaacaaaggtgaattatagtctagtggtcaattttgtggcctattctttacaaagaattgaacctgatacagttaaccatctaccccaaactattatttgtttaaaacacaatctattggctgggcgtggtggctcatgcctgtaatcccagcacatcgggaggccgaggcgggtggatcacgaggtcctgagatcgagacaatcctagccaacatggtgaaaccctgtctctactaaaaatataaaaattagccaggcgtggtggcgtgcacctgtaatcccagctactcgggagtctgagccaggagaattgcttgaacctgggaggcagaggttgcagtgaggtcatgccactacactactacactcccagcctgggcgacagagcgagactccatctcaaaaaaataaaaataaaaaaacataatctatcaaactgtgtaaaacacagtttatcaaaaaagtagttacccttggtgggtactggctggaattgggcagaaagggggcctgttggggtactgttctgtttcttgatctgagagctgattacataaaggttcttggtttgtaaaaatttattaaatggttcactgatttgtgtactttttttatatgtgaatactgcaataaggttttttattgcactgttttcagtttgttgaacagaaaaagggagactctttttgttgtttttgacctctcgacctcataatggcaatgtaggcaagaacattccctcaaggcaatacctgtgggtgtcttggttatattccaccggaaacaaagacagaggctgtccttataaaatatgtttgaagacctgtgaaactttaatagtgccttttattccatataggacagcacaattacctatgtgctggaaggaatgattgcatcatcgataaaattcgaagaaaaaactgcccagcatgccgctatcgaaaatgtcttcaggctggaatgaacctggaaggtaatataaatatctgaaagcaattgtttgtctctgtagcttataaaaatttatcattttacttttgaagatacacgtaagcagatgtaattaatgtagtcagttcagtatatatatgcttgactagcataatgttactgcccaataaaaatgggaaatttttttcatgaatatgtcatattgtttgtttatccaccagttcttcttacacacactgaattcagtacagccagactatatacaaagaaaggaaattatgtaataatgaaacttacacaacatgcagcaactttattattcttactccttttttcagcctcaaaactattccctagggttggaaatgtttctgtatcagacatatttacatgtccatttttctgtttgccttttaaaagcataccttttacttggagatctgtgttttattacagatcttcaagcggggggtggtgggaaaaaaaaaacctcaaggaagaactggatgggttttgttttggttttcaagtaaagaagaaacctgggccgggtgcagtggctcacgcctgtaatccccgaagtttgtgagaatccttctgtctagtttttatgtgaagatattaccttttccaccgtaggcctcaaagcgctccaaatatccacttgcagattctataaaatgagtgtttgaaaaactgctcaatcaaaagaaacgttcaactccatgacctgaatgcacacaacagtgagaagtttctgagaaagtttcttggtctccccgcactttgggagaccaaggcaggcggatcacgaggtcaagagatcaagatcatcctggctaacatggtgaaaccctgtctctgctaaaaacacaaaaattagcggagcgtggtggtgtcacctgtagtcccagctactcaggaggctgaggcaggagaatcacttgaacccgggaggcagaggttgcagtgagccgagatcacaccactgtactccagcttggcgacagagcaagactccgtcttggaaaaaaaaaaaaaaaaagaaacctgaaactagttataagttagagtttcatatccctgtttatataacaagttgtataattaacactgatctcagcattaaaaaattttcctctgaaaaaagtttggaattctgctgtggttgaaattgcaagttctgtgaaggtagtggtgatctcataacacatatgcttagtatttattgtgaaattagcacttttattcaacaaatatgcaccaacaaggcagtcactaggtataaaatgaataaaatagtgcctgtattcaagtagtttatctgctagttaggttgcagagtcagtcacaaaatagcatggcacaccatagagggcatagggccacaggaacaagaggaaggtcacctaattctgtcttggaagtcaaggaagaagtaacattgaattttaaatctataagctgagtaggaattagatagatgaaaaataagggcagagacatgatcagatttgtattttacaaagactaatcttacatggagagaccaattaagtgaatatggcagtcctccagataagagatggcagtactgagagagaatggaaaccatgtggttccttttatgattatgatgattattattattttagagacagagtctaactcttgtcacccaggctggagtgcagtgacatgaacatggctcactgcagccttgaactcctagactcaagccatcttcccacccagtagggctacggatgtacactaccatgcccagctgatttttttttaatttttgttttaattttttgtagagacaaaggggtcttgctatgttcccaggctggtgtctaactcctggccttaagtgatcctcccaacgtggcctcccaaagtgctggtattacaggtgtgagccactgcaactgacctatgtggttcttttgataggagagactaattgttggtgctatctagcacacactgtgtgtagacatcttgttaaatagaaaatagatttatgggtatgactatgaagagtctaattccccaaaccacacacacaactctatctacgtttgaccaggctatttaaacttaactgcagagtgtcagcatgttaaacattgatttacataaaatgatagctgcccactttcttgtaaatgttataaaaactgtagagattaactaaaaaatgcacacagaagtttgctttcagttccacaagggtagtttatttttgttataaaaacagtattccccactttcttagataccagatctctgcccagattttacccagtttcatcttgctgctctctaatctcctatgtatgtaatatactttgaccatttaaatatgtattaagacacttgagtttttagtgccctttggtttattttctccggtcccaattatctctaatcttcattttttcattttacctattttatatttcgaaataggttttgaatgaagctcaaaggacaaacccaaataaaattctgtcgtatctctaatatattgtggttgcttacccagtaacatttttaggtgcttttctgaatacatataaagtttaagatctttggagttttaagtatataatgtttttctgggcaatttctccctatccaaactatgagggccttctttcatcaaaagaaaaaagatatatcaactacaaagtaatgattttgatggactaggctacgaaatctgtccattttttcctccttcttacagtttaatagcaattgcagtgccctttgcccttactgtactagaagacgaccccaggcagtgactgacatctgatttttctattaattataccatcactgccatttccagttgaatcttttgttggacatcagaaatttttcttacatgaataaaatttaagcatacggttgggcgcggtggctcatgcctgtaatcccagcactttgggaggcctaggcaggtggatcacgaggtcaggagatcgagactatcctggctaacacggtgaaaccccgtctctactaaaaatacaaaaaattagccaggcgtggtggcgggcgcctgtagtcccagctactcgggaggctgaggcaggagaatggcatcagcccaggagttggagcttgcagtgagccaagatcgcgccactgcactccagcctgggcgacagagcgagactccgtctcaaaaaaaaaaaaaaaaaaaaaaaaaaaaaaaaaaaaaaaatttaagcatacaatttaggctgcagtttctcaaaatattgtattaaaaataaccaattatatgcttttatagtcagtataacgtatccagttagtgtagaaattggcatttgttgaaaactactacatgttagtctttgatatacattcttctactttttggaccctgattattaaaaacacctttgaatagggccatgatttactttatatccatttttatactacatagtggaagaaaattctgatttgttatttcctactatgatatgtaccgtgtggcacatatcatataaatgatccaattctacttgtagatgaattgaaagaaaggcttaaaaaagttcttagggtttgtgtgtgtggtttcactgtaaaactatcatttttgtattgaactaacctcagtatacataaaatctttatttggcctggtatgtacgtatgccaggaatctttggcagaccctaacacttacaatacagatgagccatgtgtttcacactttttttttaacaaccttcagaaatattctcttgttcatcagagtgcttcccctaagccaagcagtttcgatgatagccccagaataactttgcccaagtctctccataaatgtaacttaggactccaagtggtgtatttttatactcttgccccataccaagtaaatctcaagatttattttaagggagtggccttcactgcttaaagggcctagcatttaagaacagataagatttttaatggtgatcctaaatgtttttttttaaaaaacttgcttgtttttctcttgaaactaaatgtttttattcacttcattttaagatatattgtaatcaatccaaagtatggctttatttttagtataaacagtcaaatgaagcttagtcttgtggcattgtcagatttataaccaaatattactgaaactaatttttttaagttcaaaaacccaatctagtagtttctctcttattttcaacttttattttagattctaggggtacatgtacaggtttgttactaagatacattgtgtgatgccggtgtttggagtatgattgaacctttcatctaggaagtaagcacagtacctaacaggtgctttttaacctgtgcctcccttcctctatcccccctcttgtatttcccagtgtctgttcccatctttatgtctatgtgtactcaatgtttagctcccatttataaatgagaacatggtatttgtttttctgcattagttcatgtaggatactggccgcctgctacatccatgttgctgcaaaggacgtgatttcattctttttgtggccacatagtattccatggcatataaataccacattttctttatccagtccactgttgatgggcacctgggttggttccatgtctttgctattgcaaaccatgctgcagtgaacatatgggtacatgtgtctttttgatagaatgatttatttttctttgggtatattcccagcaataggattgctaggttgaatggtagttaaactcttaattctttgaagaatctccaaacttctttccacagtggtgtcattgtggttttgacttgcatttctctgatgattaacaatcagcatttttccatatgtttgttggccacacgtatgtctttttttgagaagtgtctgttcatgtcctttgcccatttttaatggggttgtttttgcttgttaatttaagttccatataaactctggatattagggctttgtcagatgcatagtttgcaaatattttctcccattctgtagattgtgatagtttctcttgatttgcagaaactctttagttaggtcccattgtcaatttttgtttttgttgcagtttcttttggggattagtcataaattctttcccaaggccaatgtcgagaaggttatttcctaggttttcttctaggattttcatagtttgaggtcttacatttacatctttaatccaccttactaatttttatatggcagtaggtaggggtccagtttcattcttctgcacatggatagccagttatcccagcaccattaatggaatagggagtcttttccctatggcttatttttatcaactttgtgtagattacatggctgtaggtgtgtgtctttatttctggactctattctgtaccattgtgtgtggtttttttttaccagtaccatgctgtttcggttactatagcctgtagtatagtttgatttggggtaatgtgatgttgccaactttgttctttttgcttaggattgctttggctatttggggcattttttggttccataggaattttagaatgctttttgctaattctgtgaaaaatgacattgtagtttgataggaatagtgttgaatctataaattgctttgggtagtatgaccattttaactatactgattctaccagtccatgagcatggaatgttattccatttgtttgtgtcatctttgatttctttcagcagtgttttgtagttctccttgtaaaaattttaaactaacttagatgcattcctaggtattttactctttttgtgactgttacaaatgggattgcattcttgatttggctctcagcttgaacattactggtgtatagaaatgctactgatttttgtacattgattttaaatcctgaacctttaccaaagttgtttatcagctccaggagccttttgacagagtcttcagggttttctaggtatagaatcataagtgaaaagagatcgtttgattatttattttcctatttggaagccttttatctctttctcttacctgattgttctgactaggatttccagtactatgttaaattggaatggtgacattgggcatccttgtcttattgcattaaggggaatgcttccagcttttgcccatttggtatgatgttggctgttggtttgtcatacagggctctttattactttgaggtatgttccttcaatacctagtttggtgaaggtttttatcatgaagagatgctggattttatcgcaactttttctgcatctattgagatgatcattattttttttgttatgtggtgaatcacatttattgatttgcatatgttgaacgagccttgcatcccagaaataaagcctacttgattgtggtgaattaactttttgatgtgcagctggattcagtttgctagtgttttgttgaagatttttgtatctgtgttcatcagggatattggcctgtagttttgttgttgttgttgtttctctaccaggttttggtattagaatgatgtttcccttgtagaataagttagggatgaggccctctttctagattgcttttttagaatagttttagtaggattagtaccagctcttctttgtacatctggtagaatttggctgtgaatccatctggtcaagggctttttttaattggtaggttttttattattgattcaatttcagaactcgttattggtctgttcagaatttcagtttcttcctggttcaatctaggcaggttgtgtgtttccatttccacatacatacttactccaaataatggctttatatatacgggggtcagctgaaaacaaaaatgatactttcatagtaaactccacccgcccccccacccacatacacacacacataaaccctagattttttaaagcctttgttccaatttatccatttcctctagattgtctactttgtgtgcatagaggtgcttgtaatagtgtgaagatctttttcacttctgtggaatctcttgtaatgtcatcttttacattttttattgtgcttatttgggtcttcactctttttttctttgttaatcttgctagtggtctatcaatcttgtttatcctttcaagtaaccaacttttataaactaggttttaagctaattaagatttctctactttcattaagaaggaagtagtgttaccacagactcatgaacacttctgtggagctcctgtattgactgctaatcaactatatgctccaatgggtcaggaatttatataaagttgtattaactaagttgctttaaaatagtgattgcttaactaaatgattcagttcagttaactccttcctgaagatattttgaaaaattaattagtattatttcttgctctagtcagtacagcacagttgggttcaattgtactttctgagctgtattgaaaaacatcagttttctcatttagaactatatataagtagtgagaaattaattacaaactgagtcatagaaaatgtttttttttaatcctccagcttgttactctttcttccttgttctaatgtggagtaaagaaatatgcattccaaaccatttaaagttatgactaattgaggctgtcaaagtactgtttcagtgtattgatttggcacatgtgtgttctcttttacattgtcaacaaaagtacattttatgattttggatcaagatttcactgagatacttctggttgtttaaagagtttctttatgtattggtgtctttcctttttaaaattttatcactcctctattaagttgtgatatccaaatttaaaatattctaaaaacatgttctcctgcaagttgaggtaatgatagttgttatgtggtacttactataatatatgccaggaactgttctaagcattttacatatttaattctcacaacaaccctatgaggtagggactaatattgtcctcattttacagaaggggaaatgaagagtcagggagtaacttgcacagatatccagctacaacatggcagaaccaggacttaaatccaaatatgctgatttcaggtttctgccctttagtcctatatcatactgtgcctccaagagagcatggtaaactaattagcatggttctatcatgattctgtttctattttgaactattaataaaaatttttgcaattctcagttaccccatttagtatagaacacaataagaatggaaccattctattctaacattgtacattgagatatcgttcccaccaccatatctgtcctccatagactatatggtgtgtcattttaaggacagaggatctaaaaatgatttttaaaggtgatttacatttactcttccctttgcaaaatggtttgcatccctaataatttagacaagtacatttcttcgtgatataaattacatttcttgcctttccctggaattctgagtactttccctctgagagaacaatgtaattcttatttatttagtcactaaaataacttcaggagtatgaataagtctactaaaaagtctacaggatccatgttgtagtttgagtagatggttccataccaagtcaaggtaaaagataatttatatataatatgaaaatggctgctttaggtttatagagtaatcaatataaatcttccttataaaagggaaatttcccacttataatttatgtaatgtaaagtttttcatttcatcttcccaaatgtttttagtcccacgcagtatttatgttagtacctatgtaaaggtgaaaagtgaattttttctactggtagaactaatactatttttagcatgtaatctgctgtcatcttcctatctttataagtggctttgaacaagtgtaaatagtgtaattctcttcattatatatactaccatgatttagattaatcttaaaccacagtttgtaatccgttactccaagcttagatttttttttcagtttatagtaagagtaatttgccttatataaccaatgaaattgttgcatttagagtgaaagtgagataaaaaaataatttatagaagaatttacaaaagttatttactcagattgttttaacataccgttataatactttgtataaggaataactctaatgaagtttctggcctatttgtaggcaaaattaattgggaataggttcctctggatcttttgctttcagaaaaaaaaaagttttttctccttttccatgtcactttatcataattgctaaataaaatatttctcccatcttaatagttttagaaagtaaaaatacttcttgaataaactgtgtagcgcagaccttcccattacagttcatttctatgtatttgtttaaatacccacagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtaagatgcaaaacataaaagagcaactatataaacctttgtgttttcttcagcaaaaacactttggcttttatatcatcgtgagcccatggcttatcttgtttctcttagttctggggactatgaaggggagagtcaggtgaatacaggtgatagggagtttataataaaacatttacattactccctgcttttcaaatcattatgcacaggatggtaatttcacataggatgatgtaatatcagaattcaagttacaagactcactcaaaactccttttacactgaagtttggggaaagaaaatgtttttagttaattccatttgttttccttcattgtgccacttttaaaaatcaggttgtttgtaagattggtaaacatcaagtatgttgattgtcaaaatttgtactaaagtagaatgattttaacccttcactaaatgaaatgctacacattgaatgtaattttaaagataattttaaataaaagttaccctattggaatttggtgtggaatggcagaggtcaatgttagtgtcagctctgactttaaagacagggaattgacaagcctgtgttcacgcaaatagttagggagagagcaagaaagtaacctgacctcctgtcatccttgttttattaagggggaaagaggtgtgaatagcagggcaaatgttttgcttaactcattgattaatacctcaagccaagattcttttctgttttttaaaatcaatacataatagttgtacatatttactgtacatatttatatttagggggtacatgtaataatttaataaaagcatacaacgtgtaaggatcaaatcagagtaactgggatatccatcacctcaaacatttgtttggggaacattccaaatcttctcttttagctattttgaaatataaagtaaattattgttaactatagtcatcctgttgtgctactgaacactaaaacttatttcttctaactgtatttttgcacccgtcaaccattcccgcttcatccccatcaccactatctttcccggtcactggtaaccgccaagccaagaattttggctattttactatttagttcatgtttacttaagcagacagaggtgacaaaactggctttttttttttttttttacattaaaagctattaaaaagcacctagggggctgggtgcgatggctcacgcctgtaatcccagcactttgggaagcccaggtgggtggatcagttgaggtcaggagttcgagaccagcctggccagcatagcaaaaccccatctctactaaaattacaaaaattagccgggcatggtggtatgaatctgtattcctagctacttgggaggctggcactgagaatcacttgaacccgggaggcggaggttgcagtgagccgagatggcaccattgcactccagcctgggtgacagagcaagactttgtctcaattaaaaaaaaaaaaaaaaaaaaaaacacaagagggtttgtgagtcttaaagtgtcagatgacagaagaaaactgtgtctacctagtatttaatttccattttctgttaggggtgcccttgttttgacagggctaattgatctcattgctccttggcaattcccacagagatgatcttctgaagagtgttgcctcatacctttatttctcttaattcaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagtaagttgtatgtgtgtcattttccctgtattcatagggtatctttaaccagctgatgttttcctgattgactgctattgtgataattcaggactgaaacaatcctactaggtatctaggatctaggcaaactggaaatagagttatgagtgcttggggcaggacaagtgtaatgtaaagcaaatgtacatgtggcattattactgtcccaggacatgtttgaggatatttaacagcatatctgaggttagtaaagtctgtcgcaagcaacaaggaatcttactgtgatatcatttacataaccctattccagaaagaaaaaggagcatggtaaaactcatgtggattcagtggggacaattgtagatgaggatatctaggctgatggggtgggacatatggacccagacacaagaggtatctctttgcatggcaaggctcacccagtgtctgtggtttaagaatatgggaacaaatttgttttgtttaactgagagaagaccaagcctttaagattttataaatcagctattctcttatcctctaagcttattcctgtgtctgcgaaatacttcaggtgtccatttccccttacctcattgcagttgtttcctcactcgttttctccctccagtgtaacgttcatcatgttggctaatgtttgcttcctcaagcacagtctgactgcatcacatatctccccagtacacagattgtcttcagtatcttcccactgaccctccagtacatattctgcatgatttcagactttccagaatctgacctcacttcctctcccattgttttccttcacacactcttcattcccatccatcctttccagcatactcttagactcttggtgttcacatcaccagatacacagcagagaagtcacatcctagttactctcactttctaccttgtattactacttttcgtacccctagcttattgctattagtacaatgtaaacagggagttcacacacacatacccctggtctaagaagaataaaaaatgaaggagatttctgtttgtatagaaaacagaagtcaccttgacttttattgccaaaaagaggactgttcaaactactgcatcacaatgtaacaagattaggtagttggatccaattttaaattaactggtaaatatatttagtttctggggaaactgaagacattattactcatcataatcctaccatgctgtttaaaaaataccatgttggcagtatttgttttttagtcactttctaatatgtaatttgaaggcatttaagtggaattaaaagcataaacagatttgtatgaaacaccaacttatcctggtttataaaactaacctaatttagggtttttattattagggcattcagatttagctttaagcagtcacagcaaaatctaatcatgccacatacattccttacataaagtgggatttataattttttttcctcaacagatttacattagtttcattttcattaagggatatgtacttcctattcttgtgttctcatgctgctgcctaaaagatgggcagtcctccacctttttcttttctttttttttttttttttttttgagacgagtcttactctgtcacccaggctcaagtgcagtggtgtgatcttggctcatggcaacctctgcctccagggttcaagtgattctctgcctcagcctcccgaatagctgggattacaggcgcactccaccacacttggctaattttttgtatttttagtagagacggggttttgccatattggccaggctggtcttgaactcctgacctcaagtgatccacccactttggcctcccaaagtgctgggattacaggtgtgagccaccgcacccagccctccacccttttttcttagcccactatgtttccatactgctctggtgtctgtgacaggcagatattgcatatcagaaagtatgcattcaagttctgaccctctatagagctgtcaaacagtctctcatggttgcccttaggtcagaacgttgtgggggaaaaaaaaattgttgttgtttttacagccaacaagaatgagtttttacttattctactacactataactttgttgaaattttcagttatatgagtataaccatgtacaagaaactaaaggaaaaaaaggtgcctcccagaaaaggagtgctttacctactattaaggactagggaggtgcctcttcggtaagagcagattttaaatttgaagagcctctgatcactttggcagcatataagtcatgtctaatttattttatataaaggaataaaccacatattcagtagagaaaaataataacctttctgttgttaagtccaagacgactttctgtcagaaacttaaaaaaaaaaaaaaatcttgaagcattttaaaagctgtgaactgggcccagtttcaggctcttagtgtcatttcacaagtcaggaaactttagagacctatttgaaaatcataggtatgtaatgacttcagaatcataagcaagaattggtttagtacctttagtttaaagaatattaaggcatatgcctgtcagaggcagattttgagcatcagaagtctagaatcaagttctaggtctcgccctctgcataactgtgaacagtgtcacacatttttgtctttaggatggactgctgtgaaaaaatttacctttaaaaatcaagtgtgtaggacctaaaactgtcgtctaattgaccgtattcaaatgataaaccttgatttaaatgagcaactagtaataagttctataagaattctaacactttaattaaataataaaataatacatggcatgcatgatagaaaataatatctccactgttacattagattattcattagtctatttaaacagccaagatgcaggaagtttaaggaaagttctccaaaattctgattttatagggaattagcaataatattattgcagtagttgtttttctttatgagttcatagttttgcaaaacaaaacaaaaatgtgctttttggggggaagtagcagtatttctaactaataccctgctatttatctttcacaggcagagaatgactctaccctgcatgtacgaccaatgtaaacacatgctgtatgtttcctctgagttacacaggcttcaggtatcttatgaagagtatctctgtatgaaaaccttactgcttctctcttcaggttggtagaacaccttttcaccttatgtcaaaagcatgaaatatgaaggcctagaaacaaaggttaatttatatacatagtactaataattataccaagtctactattatttcctactagtcagatgatttttatgaatgtaaaatattagaaaggcacagtaagtgacaccaagattaataagacaaataggtatggcagaaacagagaggtatatgagctgcatagggatctctgttgataagaatctgtgtagacttttttctccttccttcctttgatctttgatcatgggaagacatggaaaaagaaagctaactacagtgattttgtccactacactgttatttggttaaaaattttagtttcctaatgagtattagcatgtatgagaaattatgggagaaaaaggcgcatcctagaaaaggtgtgcttaattactattggggattggttaacatagcatgggagctggattgtcagagattcattatctagaaaatggcaacaagagtttataaaacgaacttctgtgagattactttttagctagcaaagacaaagatgtccttcagtaggtgaagtgataaactatgatacatccagatgatggaatactattgaggactaaaaagaaataagctgtcaagccatgaaaacacatggagggacgttaaatgcatattactaagtgaaaaaagctaatctgaaagggctacatactgtgtgattctaactatataacattccataaaaggcaaaactgtgaagacagcaaaaaaaaatcagcggttgccagggtttagaaggaagggagggataaatgtgcagagcacagaggatttttagggcagtgaaaatacttcgtatgatactacaatggtggaaacatgtcattatacatttatccaaacccaaagaatgtccaccaccaagagtgaaccctcaactatggactttgggtgatgatgtgtgggacaggaggtatatgaaaaatctctgtaccttcctcccaattttgctgtgaacttaaaactgctctaaaaaaagtcttttttaaaaaaagctctatgaactagttggtattataaaccttaggccatttcaagtaaaaattacatatcaatgtttattaaatactgagttaatagctgaatacctctttcatatacaaataagtacatttgcaattttttaaaaagtcttaattccattagtaactgtggtttcatagttgccaaataactgtaagctatggatgttgcacaagactgtgattttatttaatcatttcatatctatttaaacatttccaaagcgcacattcatcttaatgttttcacactatttttgctcaacaaaaagttattttatgttaatggatataagaagtattaataatatttcagtcaaggcaagagaacccgataaagatcattgctagagacgtttaatgttacctgtagcggtacacttgttaaagaagtgattaagcagttacataaaattctgatcatagctttgattgataccatgaaggtataattcagtgcctggatactaacaactttacttgtttaaaaaaaaaaaaaaaagaatggtttcaattgtatacatcccagactaattgagctatatgatttttttcattgtaaataatatcacgagttcttcttgttaaaaaataatagaatcataaggatggaaatatataccttaagatatagacttctactatgatagactactggaataggtatataacctcccaccaaaaatgctagactaaaaaaattaagaactaagtgaaggcaggaacctacagagataagtggaactcaagccaacttgctctttgacggcatttgtagaacctggtaaattagtaagtttagtaagttggggtttttttaagtttataatcttttttaaaatgatttcaataggtttttggggaacaggtagtggtaggttacatgaataagttctttagtggtgatttctgggattttggtgcacccatcacccgagcagtgtacactgtacccaatgtgtagtctttcatccctcatcccctccccaaccctagtccacaaagtccataatatcattctcatgcctttgcatcttcatagtttagctcccacttagaagtgagaacatgcaatatttggtttcccattcctgggttacttcacttacaataatggtttccagttccatccaggttgctgcaaatgccattattttgttcctttttgtggctgagtagtattccatggtatatatataccacattttctttatccactcgttgattgatgggcatttggactggttctgtatatttagtaagtttaaaaacaagggatggaaatataaatgcagttgaaaaggcagtggatggatctaaaagcagaagaatacaattgtttttaatgattgtgtatatgtttgtgtatataaaccacaagggaaatctgtaggtactgaaaatcacaacaggaaaatggcaacaaagctatagaaactggaaaagcaatgacttttcttagatccctcagagaatggaggtcataggacaaaccaccacttcaaaatctagaagaatagacaaatacagagaaacagccaagatcagcttactgggaaaagatgccactgaagccaggaagactatggcaatttgggaaaagatgccactgaagccaggaagactatggcaattttgatgaattgctggaggctgagtgaggactagcttcagagttaaaaactcccagggacccagtcttagtgggggtttcctgcaatttcttgggtttaccccacaaaatttctaacttccagaaactccacaaggttcttatggtgaagatgcaagaaaaattccctcctttttctggtaggagtagagggaaggtaaaatttggaaatacgtagcagagtgttcacaacaaaaggcctgccctgtaaggaaaactaattcaacaggcccttatgtgacctgggggaaaggcaaatagaggattctagcccttccttagccttcttgtctcatttctgaaagtcacagcccagggattcagacccactaaaaaaaactgagatttaatcataaagattaaaaaacaattcccctccccctccccaacaccttaccaccatataaacagggctccaggataaaataacagtggattacaactgagagagctgcaagacacaagctgtttaaggagctcttaggaaacccaaaaacaacagaagaaaaagtaaataaaaacaaggaaactagaggaaactgaagcctccagtacctacaattatggcaaacattaaatacagcccagctcctagccagattagcatgaaacctcacactaaaagtctaattacttcagttttgatatatcaatcatgtccagctttcagcaaaaaaactacaaggcatgctaaaaggcaagaaaaacccacggtctgaagagacaaaacaagcatcagaagcagtcctcagatatgacacaaatatttcaattatcagatagggaatttacaatacctatgattagtaggttaaaggctccaatggaaaaaagtagacaacatgcaagaagtgatgtacgcagagagatggaaactctaaaaataaatgctaaggaatgctgtaaggaaatgcagaatgatgttgatgggctcatcagtagactgagcacagccaagcaaagagtcagtgagcttgaagatagataggtcaaaggaaattcccccaaactcaaatgcaatataaacatagtagacattaatccagctgtatcagtaattactttaaatttgaatgctctaagtacaccaatcagctatttttttaactaggaggtgaaaataaagtttgccaccagatgctcactaaaaaattattagaggatatatcccagccaggcgtggtggctcacaccggtaatcccaacactttgggaggctgaggcaggcagatcacagagtcaagagatcaagaccatcctggcttacgtggtaaaaccccatctctactagaaatacaaaacttagctgggggtggtggtgcgcgcctgtagtcccagctactcaggaggctgaggcaggagaatcacttgaacctgggacgtagaggttgcagagagccaagatagcaccactgcactccagcctagtgacagagggagactccatcttagaaaaaaaataataaaagtaatcccatctttaagaaggactgaagaataacaaaagtggtaaataatatagatacatttaaactgacatttactatgtatataaaataacaacagtaacaatttccttgagggctaaaaagtagaactaaagtaagtttcaaggatgacaactagaaatagggtatgcagggtatgcaaagtaccaaaccattgggggaagagaatacctaagaaaaacaatccaaaagaatgaaagacatgagaggagggagaaaaaaatgcataaacaagggcatgataacaggaagtaacagataaggtacattagtacagctaaattcaaacacatcagtagtttagtttcattaaatatagagatggggccaggtgtagtggctcacacctataatcccagcactttgggaggctgtgggcagatcacttgaggtcaggagttcgagaccagcctgaccaacatggcgaaaccccgactctactaaaactataaaaagccgggtgtggtggtgcatgcctgttatcctagctactcgggaggctgaggcacaagaatcatttgaacctgggagatggaggttgcagtgagccaagatcgtgccactcttctccaaactgggtgacagagggacactgtctcaaaaataaaataaatgtagagatggactgaatgctccaagctaatctgacaggattttagaaataatccaaatttatgctatttaaaaaaagctatatctgaataaagatattgaaaggctgaagtaaaaggatctactttgcatagtataacccaagacatggccaactttttctgtaaagggccagatggtaaatgttgttagctttgcacagtctctgtcacagctactaaactctgcccttgtggcaggaacatagtcattgacggtactcaaatagaacaggcatggctgtgttccaataaaactttatttacaaatacaggctgcaagtaggatttggcccataggccaaagtttgctggcccctatattgaccaaaacaaaaccgaaggagctacattattaccaagcaaaatagatgttaaggcaaaatactccttaaagcatttgttcaggaaaaataattgtaaatatatagtttcaaattacataatacaaaaattcatagaacaagaatacttagataaatctagtaaaaataatgagattttactatacctttcttacaaattaagcagacaaaaaaataaggatatggatgtacatttcatctctcttgggtcaatactgaggtgtgagatcactgggacataggttgagtgtgtgtttaaatttatttttaaaattgccaaacttttccgcaattgttaacatttaccagaaatgtatgagacttcttaagatccattctatatcctcctcagtacttggtactgtcagcctctttcatcgtaggtatactgatgattaaaaatattaagcatcttttcatgggcttattggccacctatatttcttatttggtattgtgcctcttttaatcttttgcccattttttaactgggttttaagaattgttcaaatattctcaatgtggccctttgttaaatatatgttttgcatgttttctttaagtggattacatttacagttttcttaaaaaaatgtagagatgagcaaaagtgtataattttgaagaaagcttcgtgtctttgtttactaagaaagttttgcttaatccagggttaaaaagattttctactatttgttttcttatagaaattctgtagtttcagctcacatgcttaagtatatgatgcaaggtaagggacaaggttcattttcttccccaaaatccatatctggttgctccagaacttgactctcttttccctattgagttacttggcaattttgtagaaaatcagttgtttgtatatgtgtgggtctactttcagactctttttcttacccaacgatctgtatttcttacccaatgatctgtatgcctatattcatattgataacaccctgtcttgattactgttgcattacagtaaatcttgaaatttggtaatatgaattctccaaatctgttgttcttttccaaactgttgttttggatattctagtttccttgcatttccacttccttttttttttttttttttgagatggagtctcactattgttgcccaggctggagtgcagtggcatgatcttggctcatcgcagcctcagcctccccagcagtgggattgcaggcacccaccatcatgcttggctaatttttgtatttttagtagagacggggtttcgccatgttggccaggctggtctcaaaccctgacctcaggtgatccacccacctcggcctcccaaagtgctgggattacaggcatgagccactgtgcctggtcttccacgtattttttaattagcttgacaatctctaccaaaaagtcttttggggctgggtgtggtagttcatgcctgtaattccaccactttgagaggccaaggcaggcagatcgcttaagcccaggagtttgagaccagcctgggcaaaatgtcgaaaccctgtcactacacaaaatagaaaaaattagccaggcatggtagcttgtgcctgtagtcccagctacccaggaggctgaggagggaggtcaaggctgcagtgagccatgatcatgccagtgcactctagcctgggcaacagagtgagactctgtctcaaaaacacagtctgatagaatttttattaggatagccttgaatctatagatccatttgaaaataattaacatcttaaatttccaatttctggccgggcgctatggctcacgcctgtaattccagcacgttgggaggccgaggtgggcagatcatcaagtcaggagttcgagaccagcctgaccaacatggtgaaaccctgtctctactaaaaatacaaaaaaattagccaggcgtggtggcacatgcctgtagtcccagctactcaggaggctgaggcaggagaatcgcttgaatctgggaggcagaggttgcagtaagccgagattgtgccactgtactccagcctgggcaacagagtgaggctccgtctccaaaaaaaaaaaaaaaaattccagttgttgagaaagaataggaattccagctttggaggagtggggagaccatcaaatcctctttccaaaaatactactaaaatactactgagcagagtatagttccacaaatagtcttctgtaaagagactcacagtacatatttgtctttgtaggccatatagtccctgttgcaatttctcaattctacagctataacaggaaagcagctatatacagtatgtgaatgcttgtgttctaatacaaatttatttgcaaaatcaggaaaatggcttgaaatggtttaagatctagttttctgactagatcatggtatataatcttttccatatatattttgaatttggtttgctaatattttgctgatcatttttatatctctctttatgaaggatgctgatctacaactttcttttcttgtgatatctttttctggctttgctaccagggtagtactagcctcttaaaatgagttgagaagtattttctgttttcttaaagagtttatagagtattgatcttatttattctttaaatatttgatacatgttaccagtgaagccatctgggtctgtgttttctttcagggaagatttttaattatttgcttatttgttatatagatctattcagaatttatatttttccttgacatagttttgtaatttgtgtgtttctatgaaatgagccattttgtctgagttgtctaacttgggcataaagttgtttgtaatcctttaagttttgtaggatccatagaggtgtcccctccattatagattttcataatttgtgcctgatcatctttttttcatggtcagtctagttaaaaatttatcaattttgttggtctttacaaagaaccaatttttagtttcattgaaatttttagtttcattgattttctctttttgtttcctatgtcattgattattatttcttcttttctgcttgcttttcatttaatttgttcctctttttctagtttaaggtagaagcttccattgttagttgaagaccttattttcttatatagatgtttaaagctatacattttttgtatattttcattcatttcattttctaatgtccttcatgatttttttcattgacccatgtgtattgcttaatttttatatatttggggattttccatatctcttcctattcatttctaatttaattccactgaggtaggaggtacattgaaggactctaatattgaatgactccaataagtcttctgagacttttttaggcacttgcatatggtctatcctgagtgttccatgagtgcttgaaaaaaaacttactgtgctcttgttaagtagagttttatgaacgtcagttaggtcaagttgattgatagactaattcaagttttctgtatctttgctgattttctgtctagttgttctagatcctacaactttgtctacatccttgccagagcttggtatggtttttttattatcgctatcctagagagtatgtagttgacccttgtgacttgccatgcatttaatgactgcccatgttcatagcagcattattcataatagcaaaaaaaacttttatcatatgcttttgtgcctcaagatcatatatttttcgtttttagtcactaatatggtataatggtataatatactgtttaatttctgagtaattgactagcctttcattccggggataaatcctatttggttatgatatagtatcctttttacatatagctgaattcattgtactaaaattttggtatttttgcatctaaatccatgagggatatattctatagctttggtgttatgataatatggtattatttctttcttaaacgtttggtaaaactcagcagtgaagctgtcttggtttgtttggagccttttttgtagaaaggttttcaagtacaagttcatcaaatgtttactgataatatgtttattcttgagtgagctttgttggtttacatctttgaaggaatttaactgtttccttcaaatgttgaatttattggtataaagttaagttattcataatattcccataatatccttctaatggctccagtatctctagtgttattccctttcattcccgacattggtatttaatatattcttgctttttttttttttttttaatcagtctggctaaaagtttttcagttttaccaatgttttcatagaaccagcttggtcttgattttgttgttgtttatgcatgttcttagttattcgtttctactctttatcctttccatttttcttgtgtttagggtagaagcatatataattaattgagacctttcttttctaatcaaagcttttaatgctgtaaattttctaagcactgtcttcattgcatcccacacattttgatatgctgtgttttcagtactagagatttttaattttatgataccttatttaatcatgatgccttatttaatctatagcttattaaatgtcaaattctaaacatttgggtttttctccagatatgtttgttactgacttctattttaatctcatttttgtcagacagcattcattgtatgacttaatcctcctaaatgtattcagacttgttttatgttctagattaatgttctgtgtatacttgaaaagaatgcaagttcttgggtagactgtttcagaaatgtcagtcaaatttaagtcttgtttattcttattgattctgagacaaaggtgtttataatgttagatttgtctgctatatctctgacattgccaaatatccccttggaggcaaaatctccccctcccttttgagaaccactgatctatgtagccttttttctgggactaatttagccttgcttctgagatgtggcccctaggtctctactgaatgcccggcatatttaattagatctttctttcctctatggcctcaagggatttcaccctaagtatgcacaaatttttattcagccgaagactgtacagatttctggaggcctttctttgtgtacctccttcgtttccagtagtctgacccataaattgtacagatttctggaggcctttctttgtgtacctccttcgtttccagtagtctgacccataaattgtacagatttctggaggcctttctttgtgtacctccttcgtttccagtagtctgacccataaattaaagctgctttagcctccccaaacttcaatctctttctcctcaacccagcaagattgctagaccctgggttccctttcccttcactgcagtatgataattactttcaagcacaaaggtttagaattaagatttcttactcctgggctaggtatggcttaccgtatttgtttctcttttcctagggatcataatcatgtattgcttgttgtccagttttccagtaggaggggaattccaggctgtacttacttcctgcagccaaaagaggaagtaatgttagtgatttcaatattaaaacattaaaaaaaaatttaagatggatgaaattcttttatatgcatattgaattgggcttcaccatagttatttttagaattaggactaaccggcagggaaaaaaactatacggcagggaaaaaaactataagccatcgctgttttacaattttgcaataattagattttctgtagtatagtaatgtgtaaaattaacccattgttaatatagaatgccgttatcactcctgattaagcggtcttcattttcatgttaatactgatgtcttgtaatgctttatggaatcaaacattttcatacatattcattagtctaattctaatcataatccaatgaaaaagagcaggaaagatgctcaaggaggttatattcaagtccacatggcaagtaagaaataagactactcggctgggcatggtgacttactgcctgaaatcccagcactttgggaggccaaggtgagcggaattgcttgaacctgggaggcggaagtggcagtgagctgagatcatgccaatgcactccagcctaggcaacacagcaagactctgtctcgggaaaaaaataataataataagacttctagaagctcctaaatccatagcttttcctctataccagcatcttctaaaaatgtcagcagcagtgaagtttcagtttgggaaataatgcatttcccctctctggagagtgcacagttatatctccaagaagtactgaaattcagaagtctgcctaatatgtattaaacatttagcttttctcaaactttgaccaccaaatcctttgtctcgctctaactatagttaacacagaatcagtgttcccaggagcacactgtgaaaaatgtagcactctacaaaagtcctaatctccacaggattaagtgaaaccatgattaaccctctgttccttgtccttattagtaccattttctgaagagtaatgtatccccccaaaacttttatactagtttcactaaccagaatccatgtacataaggaaggacagatatttgctccctactaagacatatctattagctacattaaaaaaagtattgcatgccgattttaaagttataattaactggtgatatcacagatattccaagatataattgctggaataaacactgttgttgaagccttctatctatctcagtactagaattaaactcaagtgcagaatggcagacaaagttaactaaaaatcactgtattatttcatttggtcctccaaatagctttgtgagctaaggaggagaaggtgtatcatcaccacttccattttatagatgagaaatcaagtgatttactcaaggttaagtcctccaattctttgttatcctgcattttctcttggctgtagtttaattaataatcctaagaaaatgcttatattttagagtgcagtaagagtacataaacaatgttaaatgcccatcttgcatgtataaaaagttatagcaagaaatctggctgggaatggtggctcacacctgtaatcctggcactttgggaggccgaggcaggaggattgcttgagcccaggagtttaagaccagcctgggcaacatagggagatcctgtctctacaaaaaaatttagccagacacagtggcttgtgtcctagctactcaggaggctgaggtgggaggatcacttgagccaaggaggtcaaggctccagtgagctatgattatgccactcagacatggtggcttgtgcctacagtcctagctactcaggaggctgaggtgggaggatcacttgagccaaggaggtcaaggctccagtgagctatgattatgccactgcactccagcctggatgacacagtgagaccctatctatctcaaaaaaaaaaaaaaaagaaaagaaaagaaaaagaaaatcctttaactgacttcatcttaaccttttagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtaagtgtcaaacataaagccaaatataagagttttctgggacaaagtatgttttgattagtgaatataattatataccagcagcgcccccacccccgcccccagtttgtggatgttggtgatagcttgagttcaacttatgaacttcagttttgtagacatttttcctaaggccaattatgaaatatcctttcacctagtcatgtgtatataaaatcaccatgttattacagaatttagtaatactgtttttaaaaagtatgattaatccattaaattagaataatgcacccttcatatattatggtactacagtgattcatgaaataattctatataattctacatacaatcaaagaaatataaaatgtgttttgtacggaagtgcttatttttcatctggggaattccagtgagattggtatattctaggccagataattttttcaaaatagaggacaacaaacatgagatgttcccactgaccaatttggaagcctgatcattaccatatcttctcttgcaggtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcattatgtgactccaacatgcttttgtagaacttgtacagttccgattgtccaatctgatttttgtttactgaaagtagagttacccctgcttcaggaaccttaagataatatggtgggcatttaaatgtcagtgtggcaatgttcgcctgctaatatggcatagattcaaaataagcttaaccctggtgccaaagacctgaagattatcccatccatgcctcaaatggttgtgtgccaattactgcaaagggtactaagggaaggagaaattcactcctgaggctgcttcaaatgtatgtctttatcacaaaagatgacattttatgtaagctaatgttatctagtcaaaattcttagcttattttaaaatcaactcttcaagaaaaggaataaacatttaatataaatatcatagcagtattgcacatagaatagaaaggtcgggcagggtagtggaagtcagctattctatacaatccattcggtattttccaaaacatttgatgttcaggccatatccaggaactggatgacctaacaaacttctctgagtacctttttttccacaagagatctccatcactaagaaaaaaagcattgtgatttaaaagccaaatttgccttatccatcatcatgtgcaccaagtatttgctacctgcctactatataatattgaagatacaatgtgaataagaaaaatactattgctaccctcaatcagagtatgtgattggaaaagtgtataacaaacctttcccagtgtcttcaggtataatgcagagataccagatacggcatcaatgtgtatacacattatggctgtaccattcactttaagtagtaaccttacatttctgtagaacaccttcacatacatttttaacaagcctcactgaatgaattaatgacatgaaaataatgaggcagattattctcgtttccattttataaggaagtaaactctgtaagaaagtaaacaggctcagaatttaagcactgattcatagcccctagctcccatgttattgaaatttgaatggaaagcctctaatgaggccattcatctatcagatgtcaaagagcatgtctctggcctatgagcctctcagggaactggttatgtttttctgttttaaattaaactaatgctttactgagcacttactatgtgccacgcacaatgataattcaatatattatttcatttaatcatagtacccctctaaagtactactgtaaagcagtgctattatcctcattgcatttatatcaggaaactgtggcttaaagaattgagtaacttgcctacagtcacaaagctagctccagaatccatagttttaaaaaccactattgagaaattactaatatgagctaactagggcgaatgaacccatattgatcattatgtgtctggccttttgacatgtcctcatttaatctaatcccttttgctaccgtatcaattttgacttagaaatttaacaatgatacattagtccccgcttatctacggaggatatgttccaagactcccaatggatgcctgaaacatagatagtactgaactgcatgttttttcctatattacatacctatgataaagttaatttacaaattagatgcagcaagagattaacaataactcaattacaacaatatactgtaataaaagttatgtgaatgtgagctctcaaaaaatcgtactatactgagggtaactgagaccacggaaagtgaaaccgcagataaggcgggcactattgtatttccttctcttaaaaacgtgtcctgtaccctggggtggttgatggtggaaaatactagttgcccacagattacagaatgccctttggtttgtctaatatacaacagggagcctgtctcactaatgcccacagaaaaatcaaacatttcttcaagtgatatggagcatatagggtacagtcaaaccaaggaagaaagttgtttataaatgagaactatagtgcaagttaaaatttgctcctagttttgcaggtaaagagccagactttgggtgtagaaaaaaagttgaaaatactgaggcttttacataaggtgattttttttttttttttttttttttagaatttcaactaatctcttttaacttaagtcgttcttaacagtattggtaacttcatagcactttctttctggtgaaataaccccatcctccctcttatttaggcttcctgtttcctagttaaaatggggcagtactttgttagggaagtatttttacttcacttggttacaaacatgtaagtctcagaacaaaagagtttgtgcagaccatatcagacactcaaaagactttcttcactctacccacttgagtaagagacaatttatattctgttcaccttatgtaccctcaccaaaaatattcaatagggtaataatgtgtata

SEQ ID NO: 11 - DNA, 20001 bp, homo sapiens
  misc_feature (1)..(993): n is a, c, g, or t
  misc_feature (2653)..(2743): n is a, c, g, or t
  misc_feature (5539)..(5563): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttggccctcctaattgggtgttctcagtgaaaacgaggacactgctaatatgctttagaaaatagccctcacattctccctgttcccaatcccccacttactctaagctccccaggtagcaataattcagaagtcaaattgctcagcactcctatggttcaagtgattcttgtgtctcagcctcccaagtagctgggactacaggagcccaccaccacgcccagttaatttttgtattttttagtagagatggggtttcaccatgttgaccaggctggtctcgaactcctgacctcaagtgatccactggcctcggcctccaaaagtgttgggattacaggcgtgagccactgcgcccagcctcaaccttctagtgaaccctccatgctctgttatcttttattcctcttggatttttgttgtttcttttctttttcttcttctttttcttttctttttttttttttgagatggagtttcattcttgttgcccaggctggagtgcaatggcacaaccttggctcactgcaaccttcgcctcctgggttcaagcaatttgcctgcctcagcctcccaagtagctgggattacaggcatgtgctaccatgcctggcgaattttgtatttttagtagagacagggtttctccgtgttggtcgggctgatctcaaactcccgacctcaggtgatcagcccgccttggcctcccaaagtgctgagattacaggcatgagccaccacacccagcctttttgttgtttcttctgagagatttcttcaactcaattttccaacccttctattaaattttttaaattccagatattctatttgcagccggcaaggactcttcctgcgctctgcttgttttccaaagcattccgttctagtttttatgggagcatcatcctttcatgtctctaaggataatcagagtggttaaaatgttcttgaagttttcttctgttccctgcagtagctctgtttcctccagtttcctctttcccaagtgattggtctgtctcatatacctagaggtcttgctttgcattcacatctaagggcaaaaggcgctaggatgcagtgcggaggtccattcgctttgtcgtaaggtttgtgcctttcttagtcctgcagtggttgagtaaaacctgaccatcccacaccctcaaatactaagtgcccctgggtagtgatgtggaggggccttcttattaatgtgaggaaatgcttgtgttataggttgtggtgagaaacgctggttacaaaactatatcaaagtaaaaatgtattaatgcacagtaaagacacctggaaaaaaaatgccctttaatgctcacagaaggtctctccgaggggcagccccaccaccctcctgtttcccttcctgcatttccacgtttttctgggcccagatgcagcctcccctcccacccctggtccctccgccttggcttccggctgtcgctttcatccctcctcctcatcagccccttgcagaactccagggtggggcttctgagtctcgctggcagtatgggctccataagtcttgctggacaccgaaattaagttctgcaggtgccgtctccagaatccccagcacagatagacaaacccacatctcaggggtggggggtgcagacctgcccccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccagctgccctctgtttatatgtctcaccaatgtcaagggaaaccagaactggatagcagttgaaacacatattttgttcgggactattgtaataggggaaaaaagattttagtatagacctgggctcaactctcaatgtggcacaggcaagtggggatttagatctgaggagcagggcggggtcagtgggtggaaaattactggcacgaaacacctgtctggaggattctggctaaacccaggaaacaggaagcttgctgagggcaggcagggttagcagacatcgcctgggggtggcggaggctgagaaccctacccaggtaaaatgaagcttgctgacggcagacagggttagcagacacggcctggaggtggcagaggctaaggaacctacccaggtaaaacgaagcttgctgacggcagacagggttagcagacacggcctggaggtggcagaggctaaggaacctaccaaggtaaaatgaagcttgctgaaggcagccagggtgagcagatattgcctgggggtggcggaaactgaggaccctacccaggtaaaaggaagcctgctgaaggcaggcagggtgagcagacattgcctgtgggtagcagaggctgaggactctacccaggtaacaggaatcttgcttaaggcaggcaaggtgagcagacatcgcctgggggtggcggaggctgaggactctacccagataacaggaatcttgctgcgggcagccagggtgagcagacgtcgcctgggggtggtggaagctgaggaccctacccaggtaaaaggaagcttgctgaaggcaggcaaggtaagcagacatcgcctgggggtggcggaggctgaggaccctgatcagatatggggggatggaggcttcttgccaaactgacttagcagagttcttgctgaatctggattttataaggcagaatgcagatgagcctgtgagaaggttctgaagccggactacagtttggtcaagcaaacaatcttgtcatggattcagtcatataaataagggtcacccagcccaggggaggtgccccaccccatctgttccctctccctccccacactgagtccgaacctttcaggctttgcccccttcacacactccaaatttattcttctacttctcttcctgcaggtaccagactccggccacccagcgcttacctgggactgctgggcctctgccccgtggggacctgtcctccaggaaacaaggccagacacaggagggcagggaggactcttctccagggccggtgcgccgtctcttcagccccatggcacttgacttaggcagagcctacagcaccctcaccccagtccctgcagccaccaggaggtggtccccctcatcccattagccatcaccgccattcacagaggtctcggactgaggctggcagggggagcaccatgacccaagatcagaaccctgttgtctgtgcctctggagaggtgggggcaggagctgagggagggtttgggtggagaggggagaagatgcagtagcaggagcagatgctggcaggtagagacaaacttttatgacctttgccttctgacctttgcctctggccactgctccaactaaaacagaatggccccctctgggaacagggcttcctatgggctgggaagcatggagcccccacagtgtggctatgcaggggagtgaggaccaggtgggggcaggcctgtgggggtcacagagctgggctaagcttcagagggaagtggcccctgggagggggaatggctggggttaagaccctgggttcccacgcccccaaaacagaagtagaattagggagaaaggacccccaagaccaaggacggcacctatcagaggagctctccacgggcaggaggtgtcccagggtgagggtggccaggacaggtctagggaaatgcaggtggagcaggacccagagatggattggagatgccggaggggaggcttcctagcgggagcggagacaggcactgcagacaagtgtcagcgggaggggctctgggtggggaagaagactgggacttggaggaagacctctccagggagaagggaggagggggaaggagaaggggaggaagtgggaggaggagagtgctcatcctggaagccacagcctcggagagaactttctagaaggaaggcatgaccatcagtgtcccaggatgctgagaggccaggaaaggtgaggcctcaaggcgccatggggttgtggtgaccccaagatcactgggcacagagcagggatggctgggggtggaaggggaggggcgcgggctgaggttctagggccccaaagccaggtgtgatgtggctctagggggagtgaggaaggggagaatgtccctctgagcgtgcctcttggggaaggcaggggttctggctggggcttctccactcccaggaaaggaggtggtgtggaaggagcgggtgggacggaggagagagcgccccgcggccgcaggaccagcaggtgggggaccagggtcagcgctgctggaggggccttagcgcgacaggactggccagagaccggggatgtggcacagaaagagttaaagggcaccccagggaccgccctgccggtccacccatgtcacccatgttggcccctactccagcccccgtctgctctgcaggggaaggaaccgggagccgcggtgggggcgactgggggtgtcggtctttccagaaaatcaggcaggcatcaggaaagaaggggcgagaacccggggacgcgagaggaagggggcgagggggnnnnnnnnnnnnnnnnnnnnnnnnncgcgtcccagggcgtcccctcccgggactgggacccaccgcgaccaccacctgctgggccagggtccgcgggctcaggggtctgcaggattagggtctgcggaaccaggacccgtgggacaaaggtctgtggggcgcgggtccgcggggtggaattcagcgcgccgagtctgcgtatggccggggtacgaggcgctccctgcgcagggtgggcaggaccgaagctcgccgggagctgcgcggagggcgggcggggaccctccggtgccgctcccaccccgcggggccgcccccgagcccgccctccgccgccgccctcgccctcgtcgccgccggaaagtttgcaccgaccccgatctggcagcgccgcgaagacgagcggtcaccggcgcccgacccgagcgcgcccagaggacggcggggagccaagccgacccccgagcagcgccgcgcggtgagcacctgggccgcggacccgaggggacgttggggagtcgacccggtggggacagagaccgcggggcgggcgcggcggggccgggggcgcggggagcggggagccggccgggcggtctccggggtccgggctggtgcgctcctcagtcccgtcagacacccccgttcccaaccccggctcggacaccacccggtcctgcaccgtcgggcaggtccaggggtctcagcccctcccccgttctctggtcctggggggcgcggctgggggcgggggtgtcgctggccgcctggcgccctgcggcggccacactgcagcggccacactccccactcagggccccgggccccgccgccctggggagcgcacaaagcgccgcggacgcgtccccgaggcgcggggtctcaccagcgctgtctcccctcggtgggctcctgccccgaggactgcccggtggcaccggcgcggcccaggatggggtgaggggtgtctgcgccccgcctggccgctcctcttccgcggcccacactggcgactttgaccccggcaagcgggtcactgccctgcccggctccggcccccccggcgccccaccacccggccgactcggccaccgggcttatgctccgactctgaaccgactgaccccggccccctcggcgcccgcatcctccaaggaccggccagggctgctctctgcccttggtattggggacatcagggttggggggtctgggtgcacccacgcctgccccgcccccacggggtgagggcgcagggatagggctttgtcaacagcctgtggcccctgatcccgccccggtgccctgaccttccactaccttctctggtttcacaaaaacatcccggctcccatcccggagctcctcaaagcgtctgagaggccccttgcggacgccctgggagccccgctgccttcctggaccagtggccgctccacccatcctgggggcccagctccaggtctgcgggtccctcagccgcccccagtgggaatcggtggagcctgacgcagccaggagcgcccaagagtcacgtgttctgccagggaggacatgggacaggacacggggtgccagccctgcaaagcggccggggcagtggagctcaggtggccctaagccctggtggtggctggtgtggcccggcaggcagctgtgggagggaggaagggggtggcatgcggtgggggtctagagaaggcgggcagggcacctcgggagcccccccattgggcacctcgggaaccccccacattgggcacctcgggaaccctcccattgggcacctcgggaaccccccacattgggcacctcgggaacccccgcattgggcacctcgggaaccctcccattgggcacctcgggaacccccctattgggcacctcgggaacccccacattgggcacctcgggaaccccccctattgggcaccttgggaacccctcccctaattctcagctgactccaaggcctgagaaggagcttggtcacctggactgtgaaggtggagggtggggtccctggtgggtcgtcccacctaccagctgtgtcgccggaagggtaatacggagcactgtggccccggggagccccgagtggcagctccacagctgggagtttctgtccactccttcagtcaacaaacattgatcctgggctgaccggggcccgggggtgtcagtgtctcctctcgggggagagggctgggtgagatcaacagaggagcctcccttcttcccttcaggctggtgtcaccttcagtgatggggcagggtccccacttgggaagttaaatcgtcgtccccgtcccaggaccacagcagcctcagccctgctctccaggccaggctctctcatgggtgctcagctggaaattggtccccccccggctccacccacccctgttggggtgaggagctggagtctccctacccatatgggacccaccacccgcagggaacggaggacgctcacacttctgcacctcctgcctcactatcagagacccagtggagaattgcctcccacctcacctcttgtattcagaggccctgacccctagggatccgggactaggggtgccctatggggagcccacctgtggcctgtggatgctgagctgtcgggggaatcctccaggatccccagccccaccttcccaaccttctgttgaggctgaggggacacagagccccactcctgggtcctgactgtttcaaagaaaggcctgggggactgggcagccaacccctccctcggctcgctggggtctccagactggctgcccggctggaaggtggggccctggcacgcgaggacctcatgtgtggaggcactggcttggggggtgctcccagtggctctagagtcaacatgacaggcatcgaatggctcctgtttctctggcagagttggggcagagccaggcttggccacgctgggctctaaggggctgtcattttgcccagggagctcctggctgggtggtcctccccccagggtgagcacgcgtcccccccacccccacttcgaggcgcccaggcagggaacagctcattggccagtgtccttcctccttgtcccccgcctgcatctccaccatccaccctgctccagctgccccttgtccctctccccgtcccctgcccagagccccaggtctcccctgcacccctgagcctgcccacctagcagtgcccctcgtccagggcccctctgggttgggggtgcacacagtggggagaggcggctcctgctgctcctcacccagcccggctcagtggccggagccgcccaggacagtggcagtagatggggctgtttgatcaggatcagggaagataaggccccttgcgtgaccccagagctggggacgccaaaactgcccctcctcccccacccgcctgccgctgtctccgccagggagaggcccctactctgtgggtccttcgccccagcaccaagcctgcatggctgctcacctggctcaggaactggggatcagcgacacacgggtcctgcctcccatcggcccctacatgagcccagggtccaagggctgcggttgggagctctttagcagtctgtgacgcaggtgcctgtccctgtcattcagctgtcacactgcttggggcatctcaggccccgttagcggggcagccctgggtggagctggccccacgcgggctcacccagccgctacctggaggaggctaaaatccaggctgtcccgtggcagccagcagtccaggcctgcccggaaaccctctgctccagctgcagccttcgcccatctccttgcccctctccccggcttccccctggcactgccttccagctggctggccctccatctgcccagccatccatccacacctcttattccatttgagggtgccccaaagaagagcccgtaacagcccgggggctcatagccagccactcgcgggaccccgcacatgcacgtggacccacaggaagaccctccctgcttctcccacagaattcagttggtgcagaaactgggctctgtagcaacgaaaggccgatttgtgtagctgttgccaccccgaactcccagctcagatgctggctgtggcatggggaccaggggctgtgactcccacagccctggcaggcaccacgggggatgtcctccccaccctgtgcccccaccctaggccagctcctcctccaagtcgacgcccgcagtgctaacctcaaaggactgtgcagccagcctgtggcgtcccatgggatccaggaagcccaaccgagccttgcacggcacccacgaggcacctaggcaccccggtgctgggcagggggcacacatgtgacacagacccctgagtgtgggccccacacacttggcctggcacagctgcaagccagcccagccactttgctcgctgtggcactggggccaagtgatggaaggtccaggcaccgccaccctcacgcttggcacattggctcaggtcagcctggcaagccagctttcccaggggctaagaataggtgaggaggatggtgaggaagcagccgggggctgtcaactgagggaggaggtcaccatctggggaggctggtcccccacccaagagcattgggtcaccctgcaggaaggtggctgccaccagcaatgagacgaggggctctgcgaccctcagagctgccagccagccagccctgggtggcaagagtgactcctcctggggtctcctccctcctatcgccctctttttttttttttttttttttgagacggagtctcgctctgtcacccaggctggactgcaatggcgcaatctccgctcactgcaagctctgcctcccgggttcacatcattctcctgcctcaagctcccgagtagctgggactacaggcgcctgccaccacgcctggctaattttttgtatttttagtagacatggggtttcactgtgttagccaggatggtctcaatctccagacctcgtgatccacccccctcggcctcccaaagtgctgggattacaggtgtgagccaccacgcccagcccccagctccctctttatccctaggaccctgaggctcagaggggcagcttcaggggaggacaccccactggccaggacgccccaggctctgctgctctgccactcagctgccctcggaggagcgtacacacccaccaggactgcattgccccagctgtgcagcccctgccagatgtgggaggcagctagctgcccagaggcatgcccccctgccagccacagcgacccctgctgctgttgctgctgctgctggcctgccaggtgaggactcacagcaccctcagcacccaggggccctcctgtgaggactgcacactgatggctctctgtctgcctgcctgcctgcctgcctgtctgcctgcctgtctgtctgtctgcccgtctgcctgcccatctgcctgtctgtctgcctgtccgtctgtctgtccatctgtccatctgcctatccatctgcctgcctgtctgcctgtccgtctgcctgtctgtctgcctgtccatctgtccatctgcctatccatctgcctgcctgtctgtcggcctgcctgcctgcctgtctgtctgctgcctgtctgtccgtctgcctgtctgcctgtccgtctgcctgcctgtccgtctgcctgtccgtctgcctgcctgcctgtctgtctgcctgcctgtctgcctgcctgtccgtctgcctgtccgtctgcctgcctgtctgcctgcctgtctgcctgtctgcccgtctgcctgtctgtctgcctgtccgtctgcctgtctgtccgtctgtccatctgcctatccatctgcctgcctatctgtctgtccgtctgcctgcctgtctgtctgcctgtctgcctgtctgtctgcctgtctgtccatctgcctatccatctacctgcctgcctgtctgcctgtctgtctgcctgtctgtctgcctgcctgtctgtctgtctgtctggttgcttgtgcatgtgtcccccagccacaggtcccctccgctcaggtgatggacttcctgtttgagaagtggaagctctacggtgaccagtgtcaccacaacctgagcctgctgccccctcccacgggtgagccccccacccagagcctttcagcctgtgcctggcctcagcacttcctgagttctcttcatgggaaggttcctgggtgcttatgcagcctttgaggaccccgccaaggggccctgtcattcctcaggcccccaccaccgtgggcaggtgaggtaacgaggtaactgagccacagagctggggacttgcctcaggccgcagagccaggaaataacagaacggtggcattgccccagaaccggctgctgctgctgcccccaggcccagatgggtaataccacctacagccccgtggagttttcagtgggcagacagtgccagggcgtggaagctgggacccaggggcctgggagggctcgggtggagagtgtatatcatggcctggacacttggggtgcagggagaggatagggctggaggactcacccgggaggcagtgcctgggttcggatgagggaggcagccaccactgggcagaggggggcaggtgtggcagcctccattgggcagagggagcagatgtggcagccacaggtttggcgatgcacctgggaaggatgaaaatggcattggggttcagcccccagagagggaggtgctgagagaaggtcacggagaatgggggaccccagtgtgggtttggggcacatttgagatggggggtctccaagggaaggtgtcctgcagagctgcaattcagggctgggctgggcgtgctagcggaggctggtccaggggaggtggatggtcaggtgaggaaggtggaggtcagatgggggaggtggaggtcaagtgggggagggagcagcccaggccatgtcctgggcgaggtgacggccgagctcaggcttccagagagaggagagaggcctgctgagggagccccttctcccaccctgccctgccctgctctgccctgccctaccctaccctgcagagctggtgtgcaacagaaccttcgacaagtattcctgctggccggacacccccgccaataccacggccaacatctcctgcccctggtacctgccttggcaccacaaaggtacccatagaggggaggaactgtggggggggcgggcccagggtggggctgaccccagcctccccccacacccccagtgcaacaccgcttcgtgttcaagagatgcgggcccgacggtcagtgggtgcgtggaccccgggggcagccttggcgtgatgcctcccagtgccagatggatggcgaggagattgaggtccaggtcagtgggcggcaggcaggcgcggtggggctggatgggaacgggcatgggggcccctgcctggccctcacaggccactgtaactcgcagaaggaggtggccaagatgtacagcagcttccaggtgatgtacacagtgggctacagcctgtccctgggggccctgctcctcgccttggccatcctggggggcctcaggtaggattccgccagcgcccggggcggccgcagaggacagggaggaggacgggcgctgactggctgtgcccacagcaagctgcactgcacccgcaatgccatccacgcgaatctgtttgcgtccttcgtgctgaaagccagctccgtgctggtcattgatgggctgctcaggacccgctacagccagaaaattggcgacgacctcagtgtcagcacctggctcagtgatggagtgagcccccctcggcggccccaggcaggtgggtgggtgggcagccaggcaggtggccacgtagccgcgctcacactgcacctgtaccaggcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgagtgggctggcatgagagggggttaaggcaggctgaccaagcctttgggaccacagctgctgccccccacaggtgcccccatgctgttcgtcgtcccctgggcagtggtcaagtgtctgttcgagaacgtccagtgagtatgagcggctggacagcctggggagggaccggggggctggggtgcggcgctctggcctgaggcagggaggggccggggatgagcctggtgcctggggagggggtcatttgtgaccttctcccttccttttctgagacccgaattagatcctggcaaaatcgggacgggggtgctgaggggcggaggggctgggggctgtgccccagtatgtgagtggcctggcctcgcaggtgctggaccagcaatgacaacatgggcttctggtggatcctgcggttccccgtcttcctggccatcctggtgaggaaatgaagagccaggagcgcaccccaggcccctcctcccttggcgtcctgaggctgccccaggagacagcagcatcctgtctgagagcgctgggagggagccggcacccagacaggacaccaggacactggccagcaccctggacactgagccaggctgttcctccctggctgtgtgcccaccagccccagggctatgtggcccagggcctatcttgctgccaggcccacctgcaggagggtcaggtggggccttccaagggcacagagctgttccctggggctcgggatgcccctgactcgcacccttctcacacagatcaacttcttcatcttcgtccgcatcgttcagctgctcgtggccaagctgcgggcacggcagatgcaccacacagactacaagttccggtgggtgccgcggcagctggcgtctcgagacctggagaccctcagggccagagggcagctgggggtggggactccaagctccacgtggatggtgcgggccgagggtgggggcggtgggtgactcaggcgctgcctctgcaggctggccaagtccacgctgaccctcatccctctgctgggcgtccacgaagtggtcttcgccttcgtgacggacgagcacgcccagggcaccctgcgctccgccaagctcttcttcgacctcttcctcagctccttccaggtgcccgcccgcccgccggctcccccgcccggggcgcagtgtgccacccctgaccaccctgtctctccagggcctgctggtggctgtcctctactgcttcctcaacaaggaggtaggtgggagtgggggcatctgagaccatcagcactggccgtcggggtcaggggcagagagaggcacagggatgccagccccacccctgcccgggggttggaacacgtggggcccaagcctttccctccccctgctcttattgggtgcagttgccatggcgctgggtgtcaggcccccaggacaggttggcctcagccccatcgctacggtgtccaccgtgggggtccccaggtgtctgcagactgctttccgtggcgatgctgggtggcatagctgtgcccagcagggagcttgtgtcgctctgcacccctcagagcggagactgggcatctccgatgaggcccacagcaggtcccggtggggtggagaggacaggcaggccctaggactggcctgccccgtccccctccccaggtgcagtcggagctgcggcggcgttggcaccgctggcgcctgggcaaagtgctatgggaggagcggaacaccagcaaccacagggcctcatcttcgcccggccacggccctcccagcaaggagctgcagtttgggaggggtggtggcagccaggattcatctgcggagacccccttggctggtggcctccctagattggctgagagccccttctgaaccctgctgggaccccagctagggctggactctggcacccagagggcgtcgctggacaacccagaactggacgcccagctgaggctgggggcgggggagccaacagcagcccccacctaccccccacccccagtgtggctgtctgcgagattgggcctcctctccctgcacctgccttgtccctggtgcagaggtgagcagaggagtccagggcgggagtgggggctgtgccgtgaactgcgtgccagtgtccccacgtatgtcggcacgtcccatgtgcatggaaatgtcctccaacaataaagagctcaagtggtcaccgtgcatgtcctggaaagcagggctggaaatgctggggccgaagcagtgggggatggaacagcggtgggtggtcagcgccagtgcgggctgttgaagggtccccctgctgtcccagttcactcagagttggcactggaaccccggaggatcccgaaggcagccagcctgtgcccatctgagcaggtcctggccaccttcccatcctggttctggcgggcagtccccctggacgctttggccaccagagggtcaccattcaccagcagagacgtgaggggcacagtggctaaggcggcatgaggcatcacagtcccctgaccgaccccatcagcactggattcacccgagggcgtcttctccctggaggccgtgaggacactggcacctggctcatcggcccgcccttcctctgagcctcctggcctccgtttcatctcagctccagccccctcgggcaatttacaggccacgtagcagattgaagcgggaagaaatgggcctgaacattgccgcgggtccaggcgacggaggagggcaggttgcccaacttctgcacaggacccggggtgcgccacacacacgccagtcctcgtgccacacagagaggtccggcctacgccagtcctcgtgccacacagagaggtccggcctacgccagtcctcgtgccacacagagaggtccggcctacgccagtcctcgtgccacacagagaggtccggcctacgccagtcctcgtgccacacagagaggtccggcctacgccagtcctcgtgccacacagagaggtccggcctacgccagtcctcttgccacctcgtggtgggtgggcgccctgcttgccagccagggagcaccaggaaagagctgcctcctgcgtgctggacacaggaggtgcttcagggtggggtctcccattgtgtggggcccaacctgagtctaagggcccagggaccacacagcgggggtggagacaaattcagggtagaagctgtgaggggcctgtggtcagccccccggggggtccctgcagcaggcactgtgagacctactgaggtgtgtgcatgggctggggaaggagccagtcaggtgcccctgctctgaggagctgctgggaagtgctgctgggccctgggggaaggggtgctcacagcccctgcctgggccacgtgggctggagccgctcaggcagagccggactaattggggcaaatgaggggacaggaggcctctgaggaaaggtaaatagaattactcacccgccaggcactggggccctcctgggggggccctcaccctgccacccaccacagggcctgcatgcagcagggagggaagtgagctgattaggcaaggctggacccttctggggccctggggttgctgtgattgggacggcaaggccaggagacggtcccctgagctgcacctgctggaggcctgtgatctcagaccttaaggcttcaggccagctctacgcccctccggcctcaggtcctggctctcctctgagccctggatgcccgggtgcctgtgtgggcacgaggctgctccgagtcagcacacggaggtggacattctccttcatgccagctgagctcagggctggtgactgccctggggaaactgcccctcacctgggacctcctgacagccctccccattcccgagtccctctgcccttgtcctctttcacctctgtcccgccctcatccctaagggaactggagcaggctggtggagttgggtggagttggggactggcagggggtggactcacccaggcaataaacactggccctaaccaggcagtcctgcaggcaggtaggtggagggactgttttttttcttttttggagatagagtctcactctgttgcccaagttggagtgcagtggcatgatcttggctcactgcaaactccacctcccaggttcatgtgattctctgcctcagcctcccgagtagctgggattataggcgtgtgccacgacacctggctaatttttttttttttttttttgagacggagtttcactctcgttgcccaggctggagctcaatggcgcgatctcagctcaccgcaacctccgcctcccaggttcaagcgattctcctgccttagcctccctagtagctgggattacaggcaggtatgtgatgcccggcatcccaaaggggtatctgcaagagttgggtgctgtgtgtgcatggctgggaggaagatgactttgataccctggaatctggtgtctgtggacacaaaaatactactaaaatgagagtggagaccaggaaaaaggaagacatgaactacatgaaggaccaaatctaggagagtcagaagtgcgtcacaggaataggggaccttgagccagacagaaggctcagcagagacaccctcaaggggatgaaagggattgagtgcactaatatttagaggagagagttcaggacttgattagtgactagtacatagaaaactaaacaaatgaggctgggtgcagtggctcatgcctgtaatcccagcactttggggggccaaggcgggcgaatcacctgaggtcaggagttcgagaccagcctggccaacatggtgaaacctcgtctctactgaaaatacaaaaattagccgggcgtggtggcgggcgcctgtagtcccagctacttgggagcctgaggcaggagaatcgcttgaacctgggaggcggaggctgctgtgagccaagatggtgccattgcactccaccctgggtgacagagcaagactccgtctcaaaaaaaaaaaaaaagaaagaaaaaaccaagcaaatgaaaaaagaaggcaattaataattccaaagaaaagaaaaatttgggcagaaaagaacaaaacaagcagaatttaccatgactcagttctgaatacaaacacagacatcataatgtaaacaccaacactgatgcaaccagaatcatgggagaaaaaagatctagggagggtggtggacgggaatatcacgtatgtactgggggtaggggagagaacaaaatgggaaaaatcaagaataattcacgttagaaataaaaatacagagcaaaatttaaaaatgcaaagaatgaggtgaagagttcaaagtggtcacctcggggccgggcgcggtggctcacgcctgtgatcccagcactctgggaggctgaggcgggcggatcacaaggccaggagtttgagaccatcctggctaacaaggagaaaccccatctctactaaaaattagccaggcgtggtggtgggcgcctgtagtcccagctactcgggaggctgaggcaggagaatggcgtgaacccaggaggcgcagcttgcagtgagccgagatcgcgccactgcactccagcttgggcaacagagtgagactccgcctcaaacaaaacaaaacaaaacaaaaaaacaaagtggtcatctctaggcaaggtgggtgggagatggctagggctgcaggtccactacgtgagctggctcagcctatccccagacaccctgcactcactcagcccggggtcctccccctgcactcactcagccccgggtcctcccctgcactcactcagccccgggtcctccccctgcactcactcagccccgggtcctcccctgcctgctctttctctgaccctgccctccactgttcctttttcttctttctctccctgttgtgtccaggaaccaggcaccaccctcatttcttcttgatcaatctttaaaaaccagcagtgctcagctaactcttcatctatctcccccgacctggggctctgctgaatccacgctttagacccagctatcagctcggcatgtacagctggatgtccacaccgagctgctcaccctgtccccagcttcttcctcccactgtccactgcagaagcctcctaacaggacccctgctgctaccccggaccctgcaacccattcccacacagcagccagatgctttgacacccgaagtctcctatgaatccgatgaggcctctgcaccacacctcattttacagaagtacaggggaaacaggggtctgttgacaccacagagatgcagctggccaaaggcagaatgtggggtacacgactgtcaaacgccaggggtccttacacgaatggtggaaaaagaggggcatgttacggatggaggctcgggacacatgggcgccgccttcccatgctgccagcaacccaccaggaacctatta

SEQ ID NO: 12 - DNA, 3182 bp, Hepatitis B virus
aattccacaacctttcaccaaactctgcaagatcccagagtgagaggcctgtatttccctgctggtggctccagttcaggagcagtaaaccctgttccgactactgcctctcccttatcgtcaatcttctcgaggattggggaccctgcgctgaacatggagaacatcacatcaggattcctaggaccccttctcgtgttacaggcggggtttttcttgttgacaagaatcctcacaataccgcagagtctagactcgtggtggacttctctcaattttctagggggaactaccgtgtgtcttggccaaaattcgcagtccccaacctccaatcactcaccaacctcctgtcctccaacttgtcctggttatcgctggatgtgtctgcggcgttttatcatcttcctcttcatcctgctgctatgcctcatcttcttgttggttcttctggactatcaaggtatgttgcccgtttgtcctctaattccaggatcctcaaccaccagcacgggaccatgccgaacctgcatgactactgctcaaggaacctctatgtatccctcctgttgctgtaccaaaccttcggacggaaattgcacctgtattcccatcccatcatcctgggctttcggaaaattcctatgggagtgggcctcagcccgtttctcctggctcagtttactagtgccatttgttcagtggttcgtagggctttcccccactgtttggctttcagttatatggatgatgtggtattgggggccaagtctgtacagcatcttgagtccctttttaccgctgttaccaattttcttttgtctttgggtatacatttaaaccctaacaaaacaaagagatggggttactctctgaattttatgggttatgtcattggaagttatgggtccttgccacaagaacacatcatacaaaaaatcaaagaatgttttagaaaacttcctattaacaggcctattgattggaaagtatgtcaacgaattgtgggtcttttgggttttgctgccccatttacacaatgtggttatcctgcgttaatgcccttgtatgcatgtattcaatctaagcaggctttcactttctcgccaacttacaaggcctttctgtgtaaacaatacctgaacctttaccccgttgcccggcaacggccaggtctgtgccaagtgtttgctgacgcaacccccactggctggggcttggtcatgggccatcagcgcgtgcgtggaaccttttcggctcctctgccgatccatactgcggaactcctagccgcttgttttgctcgcagcaggtctggagcaaacattatcgggactgataactctgttgtcctctcccgcaaatatacatcgtatccatggctgctaggctgtgctgccaactggatcctgcgcgggacgtcctttgtttacgtcccgtcggcgctgaatcctgcggacgacccttctcggggtcgcttgggactctctcgtccccttctccgtctgccgttccgaccgaccacggggcgcacctctctttacgcggactccccgtctgtgccttctcatctgccggaccgtgtgcacttcgcttcacctctgcacgtcgcatggagaccaccgtgaacgcccaccgaatgttgcccaaggtcttacataagaggactcttggactctctgcaatgtcaacgaccgaccttgaggcatacttcaaagactgtttgtttaaagactgggaggagttgggggaggagattagattaaaggtctttgtactaggaggctgtaggcataaattggtctgcgcaccagcaccatgcaactttttcacctctgcctaatcatctcttgttcatgtcctactgttcaagcctccaagctgtgccttgggtggctttggggcatggacatcgacccttataaagaatttggagctactgtggagttactctcgtttttgccttctgacttctttccttcagtacgagatcttctagataccgcctcagctctgtatcgggaagccttagagtctcctgagcattgttcacctcaccatactgcactcaggcaagcaattctttgctggggggaactaatgactctagctacctgggtgggtgttaatttggaagatccagcatctagagacctagtagtcagttatgtcaacactaatatgggcctaaagttcaggcaactcttgtggtttcacatttcttgtctcacttttggaagagaaaccgttatagagtatttggtgtctttcggagtgtggattcgcactcctccagcttatagaccaccaaatgcccctatcctatcaacacttccggaaactactgttgttagacgacgaggcaggtcccctagaagaagaactccctcgcctcgcagacgaaggtctcaatcgccgcgtcgcagaagatctcaatctcgggaacctcaatgttagtattccttggactcataaggtggggaactttactggtctttattcttctactgtacctgtctttaatcctcattggaaaacaccatcttttcctaatatacatttacaccaagacattatcaaaaaatgtgaacagtttgtaggcccacttacagttaatgagaaaagaagattgcaattgattatgcctgctaggttttatccaaaggttaccaaatatttaccattggataagggtattaaaccttattatccagaacatctagttaatcattacttccaaactagacactatttacacactctatggaaggcgggtatattatataagagagaaacaacacatagcgcctcattttgtgggtcaccatattcttgggaacaagatctacagcatggggcagaatctttccaccagcaatcctctgggattctttcccgaccaccagttggatccagccttcagagcaaacacagcaaatccagattgggacttcaatcccaacaaggacacctggccagacgccaacaaggtaggagctggagcattcgggctgggtttcaccccaccgcacggaggccttttggggtggagccctcaggctcagggcatactacaaactttgccagcaaatccgcctcctgcctccaccaatcgccagacaggaaggcagcctaccccgctgtctccacctttgagaaacactcatcctcaggccatgcagtgg

SEQ ID NO: 13 - DNA, 3318 bp, homo sapiens
gtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaa

SEQ ID NO: 14 - DNA, 78001 bp, homo sapiens
cagattccgggtctcatccctagaccaaagatatctgaatcatttggcgatgggtccaggaacctgcattattcaacacacttcccaggtgaccgtaaatgtcaaaagacaaaattacaacaaacttaaacatcttaattggcttcattcatgattctagaatcgggcaagacttcattcctcaaaatagcacaagtgtcccaatgagctgagcagaggaggttggttttatagacagaaaagggctgaaaaaagcagaaacaaagaacaaaaagcagattggtcatttcaaagttactttccttgtaaggcaggaacagggaaacagaacaagagagaaataactgattggtcgcatcgggttacttcaggttactttttgttgtaaggattaaagcaaagggaacttcattatgttgattaaaacggtctgcttgggaaatcagggtgtgtatctctcttctgattttgtgaaaggttatcagtctgatgatgtagaactttagcatgagtgactccattttgatttttagtctagtctgttgagaccctaatgccagaactttttttgtttgtttgtttcgctcttgttgcccaggctggagtgcagtggagctatcttggctcactgcaacctctgcctccagggttcaagcgattctcctgcctcagcctcccaagtagctgggattacaggcatgcgccaccacgcccggctaatttttttttttttttttttttttagcagaaaccgagtttcaccatgttggtcaggctggtctcggactcttgacctcaggtgatccacctgcgtcggtctcccaaagtgctgggattacaggtgtgagccaccacacccagcccttttttttcaagacagggtctctctctgccacccaaggtggagtgcagtggcgccaaaacagctcactgcagcttccacctcctgggctcaggtgatcttcctgcctcagcctccccagcagctgggccccaccacaccggctaattttttaacttttagtagtgacgaggtctgattctgttacccaggctggtctggaactcctggcctcaagacatccgcctgcctctgcctcccaaagtgctgggattacagatgtaagccaccgcgcctgggctcctatgatttttatttaacataatgcaccatggaatttgtgctctgcttagttcagtctgagcaggagttccttgatacttcgggaaacactgaaaatcattccatccccatccattcattcctgcagcacccaagtggaaattctgcgtttcagacagggacactacccttagagagcagtgggcttccccagcagcgtagtgaaacatgatactcctgagtttcatgaaaaaagggcagacatctggccagagctgggaggcaggaaatagagcacggtgccctcctcccatactccagcttggattactgaggctggggcccaggccctgcaggaaaggaggtgcatgactactttaaggccactcactctgtgactcaacgggccgggtcggggctggaactcaatgccctcccgggcctggagagcccacgcgccgtgggcggggctcccggggtcgcctaggcaacaggcgcgcgccgcgcccgagcccagagccccaaagcggaggagggaacgcgcgctattagatatctcgcggtgctggggccacttcccctagcaccgcccccggctcctccccgcggaagtgcttgtcgaaattctcgatcgctgattggtccttctgcttcaggggcggagcccctggcaggcgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggtgcgggagcgccccggagcgtggcgggcccttcgcttaggccgcttgaacatcccctcagacctccaggccccagactccctctgggtcttgccctctgcctcgctcctactgcttgaggattcgatgggacagcgacgcactgcgtccccccaccctttgtccccggggcgggcgtgtttctcgccgcagcgtcggagcccccttcgatcccccacctcccttctgttctccagctcgggtgatctctcaagccgggggaccgccggtctgtgctctcaacgcgaatccctcgcaccccgaccccgccccctgcctgtccactctttgtcccctggggtgatttagcacccccactatttccttttctggagtggaccacctcagactctcttcctttgtctccctgggggaaaaggttactccccccgtccctccttcacatttcctttcccctagtctcagtgtgcgtcgagtcccagagatgacagtcccctttcccctttctgttcattcatttattggataggagttggcaagcttattctgtgctaggcaccgcttaggcattggaggtggtgtttgctaatcaggacaggcaagatcctagccttagtggggcctagagtcgaatagggcaatcaaacacaaaagcaaataatttcagatagtgacaggtgctgtgaagagaacgacttcctaacggggtacagggtgactgcatagaaggccggctgtcttagagaaggggatcagggaaggcctgtcaaaggaggagacatttgctttgtgagctgaaccaagaggagcagaaagccgtgagaatatggggctaaagaaccttctagccaggaggcctgcggtacccactccattggggccatgatattattctttcaggcagggactcaggaaggttaacgttttaaccctctctaaaatagcatctttcctcaatgagcagcttagtctttggtcgtggcagagatgaccttgtcttaggagtcatctccttgtgtgttaaaaagttaggaaaggagggtttctcatatatctataaaacaagtagttaaaaacacaaagagctcttcctttcacaagcagctgaataagatacatactcccaattaaatgtcattgcgggggttgttaagattaactaaaaccacacttgcacagtatcttaaataagcgatatacagaatagagagattttgttacttgtgtaaagggagacagcagatgattctgttttcagcttataggctcaaaaggcaaattgtgagatccatcagctgtagtattaaaatctattttgagctccgcttagaaaggaaaaaaggtttaagcagttctttggtatgcttgactaacaaaagcctttttttttggcagccttgattttcatgtggatttacatcaagcttatttgacaggattctttttatttggactgtagtgtgtatattagtttctgctagactaatatttctaaccactgtaatctatatactaataagtatgattgatcagtatataaaatttgtatgccatatctggtctctgaattagctgaatgaattccataagggactttgagactgtgtagacaaattttctgcatcagtttaatgcagtagagtctaaaatgtctttaaatgaaaattgttggtctgaagtgttggagttgattatgatacaccccatcacagtggaagcattgtggagagaagtcttttccactgaaattgactgagttgacaacaagaaatacgtattgtaacttagttcttagttgaattttatttcttacaattttaagccagagtgggttgacctgtcacccaagcatggttaaaattgtattcagcatgcaactagcatggagtgtgtcagtcttcaattcatttccttcattgttcttaagtttttctgccacaattaaaccccacaagttagtcaaggtgttgagattttcactgcttcttaatggattgccacattccctgaggtagtttcttttggtcttagagaattgtcagggccagcttttctcacctccactgtatggatatttttcttttctaagatcttgaaatcagaagcttttctcctaagtgtaaaagtagctctttgtcatacaactgtagcgttttctgaaacagagttcagatgaccttgagtctaaagtggctaactttccaaggtgtgtatcgctttaccaaaaccattatttttcaaggattcaaagaatgtgtttacaattgatagaaaatggaagtttaaaaaaattaatactttatagcatgttgaaatgagggcagccttatacaaagtcatactttgagcttgcctagcctattgtgatcagagaataatgtaatttttgcttacaacttggtaagcaggtcagttattctaacttattttctgattagaacaaaaagatgtaaaaacttgaaaactattgggaaaagaacaaagagtgaagaggacttttgagtgctgaggaatgtggcagcttggaaaacaaactttttaggcagagattctttgctaggtcagtttgataaagtgagcataaccgtatttttaatctttaatgctaatgaatagcatagatgctaataagcatctaggtctataaaaagtcagctttgatagtgtatatagatggctttaaacattgttttctagcatttaaacactttcaaatcatccggttgcttgattgggcctagctgtctaagaggagagaatgagcccagatgaggaaaagagattgattttactgagctagaatgagaggagagagggttgagtgaatgaaaagaatagctcatgtgctcccctccatctgtagtttaagaggggttgggtccggtgttttgcttgttttctcgtctgtaaattctttgattctctgacaccactcactatatttcattgtgaatgatttgattgtttcagataaaggggactgcaataataccttgtgacatgaaggcaagatttattcatgttagaggcaggctttgtaaaatgggccactcttccaattgacatttgtttttatagctgttttcattatgaaatacaatctaatgcctgactaggttaaaaccatgttgtaacaatagttcactaaaattccttactgatatacagcttatgttgttatattccaaaaagatgaatattaaaatttgccaataatgtttatttaaatactattttcttcagaggaaaaaaaactattttatgcaaaggagaaagatctatacactatgactcacttcacttaaaaaaaaaaagactaacggaaatgacatggagagactgggaagttctagtcatcttgagtgacccattagatctaaatgttcttgtttagccctggtttgagtgaactaaatttaggtgtctgatcagtactttggaaatggtgtaaatgcctttgtaattgtctggactgatattagattaactgggagcacaagtagaaatagtgaaggaaagaactttttgctattgttatttgacatcactggcatatttataggaatactttggtgtttttggaagtaagtaaaccaaccagtggttctaaaaagtcagctgggggataatggtaatgccgctgtttcttagctgcaagttatctgccgttacttctcctccattttgcattttatcttgaatagctcctcaaaacctattaaaatacctggtattgaataatgtaattgaatgtgtactgaatttcacagtggaaatgaataagaaatttcctgtggaggttttttgacttagctactgaaataacggccttttgttgtgtgattctttcccttttctctttgttaaagaaaactgtcttgtgatcttgtagattacagaatccttttggcaatttctgttcctagcactgctttttctttctttctttcttttaaatagaaatggggttttgctgtgttgcccaggttggtcttgaactcctggcttcaagcgatcctcccaccttggcctcctgaagttgggattgcaggcgtgagcaggtactttttctgaggcctgcctgagcctatatatattttgcacaatttggcattcctccctacagtgtttatgctgatttgtttctggtaacaactaatactggcaaatcggctgggcatgttactttatgctgcccatattcaggaaaattggaattctagctgggtcattgttcccagatgatgtagtttggcaccagccattccatgttcacattttgagtatccaggagggctggggactttggagtagttggtgattccctctgccacatttcactggttggtcactatggcatcctttccaccacactagtagtctaggttctcagatgttgcttatgagcctgcaatggtttctagtttcacactgcagaaatgagtgaagccggttacccgttaatatggtcccatcatcactagagtaattcattgttctaaaaccagatctgagtctctcactcctctgcaactacttctgattctttcataacacttgtaaagtccaaactcctctttagcatggcagccagcttccagtccttccctcctatgtggcttccattctagccagacaagaaagggcagcgttctccaaactcatcctcgcccttcattcctctataccattgctgagcactttgttgaggatgcctctcccgttcaatctagcttgcatcttccagctcgaatgtgtgcttccttgcaccagagttttgttccgtcacctgtgtgttttcatacaagctggcacatatctcttctaaagccctgctgtcattgtagctgcgtctttacaaacattttttttttaaatttttataaagtcaaggtctcactatattgcccaggctggtctcaaactcctgggctcaagtgatcctcctgccttggcctcccagagtgctgggattataggtatgagacactgtgcccagctgtagctgctactttatatcccaggtctatctccaatggagcccaagcttcctgaggccacctgttgtatctttctcattcatcttgaagtcctctgctcctggcacagagtaggtacctaacaagagttgggattgaattgatggtcagtactttgctagcctgatggtataaagatgtacaaaacatgttcctggctcccactctaggggggcaatgatggaaacaaatagattagcccacattagtaccaatagtagaggtcactctgggagaaggcccccaccacattttgagtcatggcctaatgaggtaatttagtattgcctgctgcagtggctttggaagaaaggctggcattcttagccagtagaagctgataccactgatttgtttcacagaagctttaaatataacaataaatttgtgcttggcctacggtgaactttacaggcaacttggaggtaatatgtttgtctctctaagaattgttgaattcctcttccctcatccctcctgactggttctcacaagcctagcgggcctttgcatgtggttggttcataaaatactttttgattttgggatataaaatatagttctccataaaataacgactgttaccaagtctttgattttttttttcaaactataaatggtaatgacattctttggcctttgatcagaccacccttaggggcaagagagtagtttcatgttttgctttttctagtgtcccctgtgtctgggtatagttgcagtctcagctgtcatactaacagtgctgagtgagtcccttactttctttgggttttggtttctcccttgtaaaaatgatcctggactaactgatcattaagttcaggtcaagtaataaaaatccttaatgtactcacaaatacaatttaatgttcctgaataatccttgtaaaaactgcagcagttactcagttttgtaaggtgtggttgggtactattaggctcaaaagtttataggagctttgtgagtatagttaacaactcaaaagaatggggtgttttttcccgaggggcatgaaatgtttttgataaatagagttcatttgacttggtaatgtggaaaatgagtagccctgacacgtacgctatgcttttgcagtttttctctcaagtagcaattgggtggcttttcctgtaaaagatagaggaactgattcttgagaatttacgaaagcttcaaccctaactaggtatgcaaagaatagttgccctttatgttgtaattttaggaagaaacctacatctggtctaagtttcatttgaataatatgatagtttacacatctgccatatttgagaagaaagtacctaagtctccagcattttagaaataatgctttactttgtgtagaaatggtctttagagtttaatagctgctgccctctcctttttcaaagcagcttgacataatcatgagtatcttgctgacagcttgtaaattttgattgtatgaaaactgaaaataagaccatttcacatggaagattccctcctgccctgaaacagccaaagaaaactgtagccatcaaatctattgatctctgggctttggtacaagtcacactactacaaataaaataataccaagtacttataaatgattttcagtccttttaaagtttatttttttaatattttttttgagatggggtcttgctgtgtcgtccaggctggagtgcagtggcacaatcttggctcactgcaacctccacctcctgggctcaagtgatcctcccacctcaggctcccaagtagctgagactacaggcatgtgccatcacgcccagctaatttttgtatttttttggagtagagatgggattttgctgtgttgcccaggctggtcttgaactcctgggcttaagccatctgtctgcctcaggctcccaaagtgttgggattacaggtgtgagccactgtgcccggcccagccctttttttaagagaaaaacgtatgacatcgttcgatttactgagtgcttatggttttactaaggcagtaaggttttatggataccctatggtaattagatagaattagtgctctgaagtcagctctgtaatatggactcagagtaaacatggcaaagggacacttaaggtctgcattttctctgggaaataaacgtattctttactactctgaatctagtgctgggaaattctaaatccttcttgaggattaaccacttgaagtaaagttttgggtcccaagtaggcttgtgtccctgtctccttctctttacttttcagatgtttcttcctagagactgaggtatattttacttttacagatgaagaaggaagcctcggctgtgtttgtggcttttgtgggtgagcaacatcacttgcaaagataagatgagcatagcaaaactaggctttcaaaataatttttaaaaatttcttagtgattagaaaaggaaaactcttcccttgtctctgttaagaaacgtttttcgacttttttcctttcttaatggatcttttattggcacttctcttccttttgcagaatcttacttaaaagtcactacgttacattacagcaaacagcttagctaatttttatccagatgggccccggttacaggattgtacactattgcgaatttcttacaggaaagtgaacatcaagtaattattccaaatagagttctcttaagaacgtgagttacttaaaaatgtctaaggatgaagtcacttctgaatataacttcactcaagagaacaaataagcaaactgcatttagcataacatggtaaattagctttaactctccttgatgtttgaacatttgtcgctgttaactactgtttcacttttcaaatagtcagggcttagtttgcttctgtaaggataaagggaaaatacgccttcactgagtcataaatatttttgtggctaacttttgcacagagaaaagaggcctctaagaaggtacccagtgaatttttttttcggggcagggagagaatatgtcattttttggtttgttgttgttgttgtcattgttttgctttgttgtttttactctgaactgaactgtatcttgacagcacttttgaattaagagcattactcttattgttctctactacctggacgccacctccctgttgccatagtgttaaggatcatgctccgaggtggggtgaggcagaatggggccaagatcagaaagttacattaagctacatcaggtttatacaagcataaaaccaaatttttggagcagtccccagaatacaacctggtttagccacacctaaaggttgctcttgaatattccttgagaatccacatccctagaatgctgggtttcaatgggccctttatgtacctatcatggtgtcatttctgagcatttctaaatattccttcatgtcttactgacagtttttcttgaataaatcttaggaatattagtgccattatcagtattttgtttggtctgttcacaccacaaataactacccaggtctgctacttgcccctatttctctacctgctaatgaaaatgcttttgaaagtttgagtaacagtattggagtgtgcacagtggtattggtaggttctgtactcatccttaaccacttgttttcatcctttgtgagcttgaagtttctccaaaaaatttatcacaaaacttatcagacatagttaatacactcagagagagaatcactgaaaaagtagatgtagtttaacaaacccagtgccttttttttacccatgaatacatatttgtcaactaaacctcattttgcaacttgttccactactcgaatggtaacaaacttttggtttcccaatagatttggaagatgttgcttttgaaagtaggaaatagatggctttagaagatggaagaatattttgtttgaagtgggagcgtggtatgtccttagctgtctgtgaaatgcagctgaagatgggtgtgggccttcatctgcatttcccatcttcagtttgaggaggtagttacccttctaaccacttaagaactgcatggtacatgctgttttatttacagggcaaaactgtgctcccgtagtttccctggtgcttgccttcacgttaacacagtgtcatcgtttggcagtgtttatgtgccagggtccatgttagaaggaggaaaggtatagcgaagttaaagggtgcagttggcctcccacctttagttttgtaagtgcctttaaagtttgatttttgtaggttgatcataaggaagtgataagtatgttaggttatttgtggtttgagctaattttagtctctttttacagcttgctttgtatcctttgccattaaaacatgctttctagaaagacaacttttgaatgtaggacacagtctatattctatacttggctacatttcaaaaaatattttctcagtactttggaagttggacagttggaagcatagtgacagtatttaaaaatctttgattccggccgggcatggtggctcacgcctgtaatcccagcactttgggaggccgaggtgggtggatcacttgaggtccggagttcaggaccagcctgaccaacatggtgaaaccctgtctctactaaaaatacaaaattagccgagcgtggtggtacatgcctgtaatcccagctactcaggaggctgaggcaggagaatcgcttgaatctgggaggcggaggttgcattgagccgagatcataccattgcactacagcctgggggacaagagtgaaactctgtctcaaaaaaaaaaaaaaaattaagtgatttctttgctttgtgacacttctacttttccagcaagtaaattatattctttcatacaggtatgaaattcttgttccaagctagtggttaaaaaggcacagttgatattagaggatttgtaaaagattatgaccacgcctgcaatgtactgaagcaaggctttgctgggctgtgtataggaaaccttccccagcctgtgcccttgcttgatagaacattttgctcctaagggtaggtgcctgtatctgtctccagtactggttagtttcacacagaacagttgtgtttcagagctttagtctcaagctgccctgctcccctgaagcagccaccctgagcatgtgcactcacaggaggggacatgtgaggtcatggaagaagacgactcaggaagaagaagacttgggtttgggttctgactctgcctttgactgttgtgggattttgaggagttgcatacaggatctgtaaaatgtagtcattagactagactagacagccatatagcattacctagatgtaactttctacaaagacatggtcacaggagaagaccagagggtggggtgatctttctggaaaaattggggcttcatgccttactcatgctagatatggtagcattatatggctgtgcctgatccccctaatctaaaagtgggacagaactttaaaatttcatattaactcaaattaaaacttgaaaaaaacccattatttccttaaaaataataaaatgccctgtgggggcataagtcacattatattttaaaattcctgaatgccacatggatgaatgtagttccttttgaaattcttcttttgtctaaagaggaatgttggattttgtaattggactaaaaaatcttccatttgagagagaaacagtctgctgcatgttctacccttgttcaggataaaacccactaatagctaacatttattgaattctgtgttgtgcctcaggcactgtgcaaagtcctttacatgcaatgctgtttattatatactgtcaattggtctataacagcaggaaatgtttcaggaggacaatgaggtcccagaccctcagtcttctcctgtgtcctggattcagcttcacaatagcactatggcagtgtggccactgcttcagcttccacatacatggctgtgaagagagacaggggattgtgctaagcctccccgatttattaggacataggaggagagagtttgtagtttttgacctttgcctagttttctaacctctttcctagatgtcacaaattggccacccacagtcatattttgcttgcttcacgcaatgctttttaaaaaagagaagagtttaatttgtgccattgtttataaatgaatcaggagaaatgacatgcaactctggattctggcctctcttgaaaaatctgaaaatcacaccgtctgagcttacactggcagtggtctgctggactgagggacacaactccttttggatgtacatgtgtgcgttgcagagtttaccacagtcccacagtgggtcacactgtccttgtcggtgtacactacctagcacttgagtttgcaacccctaccccaagctgagttttctcgtcaagcttgatgttaatgttatgtgatgcttggccttgtaggtatttggtatattatcgttagataaaattgaagcaaagggctaaagggttggtggcctgagggagtgcccttgacagtaaagtctaggataaaatcattggccaggtactccttcccttcccgcccttcctcttttctctttatcctcagcctccttctgctattttgaggaagttagaagccaccaccattttttcccacctcaggcaactgagtgtggctgtatttctgtcccatgttcagttatttccaggaactatttttgatgaccaacttgaagttacattgggtgggcctaatgggggctgataaaagaatgaggtgaccaaatatgcttgcactgagacggctacgaagtaaggtttttaatgacttgctttgtgacttggtcaggagtgataccatttgtcatgtgtccaacttcatgactaaatggttgctctaccttatcctcatagctataataaaataaaataaatacatacattgcagggaggaatgtatcttgttaaaggtctctcccttttagcaacaaaagtacatattatgttgtagaacatgctttttctttgatccttcttgaacacctattactctatagaggtatgttgtgtatggcaaattagaacaagcaatagataaggatgattctttaccattataacccagtcaaggtctttgtcctaagttttgtacctttctccagagggaaaggtatttgtatttatttatttatttttgaggcagagttttgctcttgttgcccaggctggggtgcaatggcacgatctcagctcactgtaacatccgcctcccgagttcaagtgattctcctgcctcagcctcccgagtagctgggattacaggtgcctgccacgatgcccggctaatttttttttttttttttgtatttttagtagagatggggtttcatcatgttggccaggctggtcttgaactcctgacctcaggtgatccatccacctcggcctcccaaagtgttgggattacaggcatcagccactgcctccggccaggtatttgtatttttagtctctatgccttaccgtctcagatcaggaggatttggtgatttatcgaatgtgggggaaggggaagaagaggaaacgggaggaatgttccagattagggaaatagctagatggaagatgcagcccctcatcaaggtggggacacaggaaaaggaacgtgtgcaaagaagatggtgatctggttgtgaccatgttgttagaggacgtccagggaagcatctggtaggtggtggggtgtttaaatatagaacattcggagaatgctccgaagcttcagagaacccttcccaaaaggacaaaaccagctcagtgttttagcactccgggatcatatggcatgacagcatggctgctttatacttttttgtgtatgtgaaattaaaaccaaccactcaggaccaatttctctgaagctttttgtcaatctttcatttgcttttctcgtctagattgtaagctccttgcagccagtgtctgttgattcagtcattcaaaaaataatacatgaacagctactaggtaccaggctctgtgctgggcagttgggatatgtggtgaggaagacaaacttggtccctgcccttaggaagttcagtagtccagcagacaaagtggctgaataaagataatctcagttcacagtgataagagctcttacaggcctaggctccaggtgctgtggggatgctcaggaaaaggtatctaattgggattgggagcaggcaaaacaaataaaggatagtgtataaaggtaatatctagttgaagttctgaagggcaaggaggagtgagcctgtatattctctgagtctctccctaatctgggattgacttcttgtccgtctctgttcatattaagtgtcacctaggcttgaaagggtgagatcatatttcacttccttcctctttggtcttaacctttctctgctaccccctcacacaatgcatatgcattattctcttattgtatatatttttcctctcttccttttcatgtttcctctgccattacttttaacctcgactgccatatggcctctaaacgcttccagaagggtagcctagtggaggttattccatcatggccttgagctcatgcgaccagatagtgaaggcatctgtgtaggtgtcttctccaggagggtgatatttgtttcattgtaaattttgtagccctagaacaccaacaacagtgcacagtaattagtaggcaggcagtacaggattcattgaagtgaagtgataacttttatccaagtatgtatgcagataatctttgatttgtacaaaaaaaattatattttaatatgtaaagattttttaaaagaatcttcaagttttagccttcccactaggaatatattgaaaacatgtgcctagttcactgacttgcagctgccactatgagaataaaggtctcatttagttgttgtgaattttaagggatattttcaatgatgttggctggtttatcccattatgtggtctttttttttttttttttttttttttgaggtggagtctcgctctgtcacccaggctggagtgcagtggcgcaatctcgactcactgcaacctccgcctcccgggttcaagcgattctgctgtctcagcctcctaagtagctgggattacaggcgcctgccactacgcccagctaatttttggtatttttggtagagaagggtttcaccatgttggtcaggctggtctcgaactcctgacctcatgatccactcacttcagcctcccaaagtgctgggattacaggcgtgagccaccatgcccagcctatgtgctcttattagcaattctcagtacacagatagctttgagtgattctttcaagtcaagtaccttattaaaaaactcaagtgtactgataattatcttacttttaaatggctaagtgataagactgaatttttaggtactgtaacacttcagattacagattctgatatttttatggttatttatatttatttatttttgagatggagttttgctcttgctgcctaggctggagtgcaatggcacgatctcggctcactgcaacctccgcctcccaggttcaagcgattctcctgcctcagcctcctgagtagctgggattacagtcacccgccactacagccggctaatttttgttatttttaatagagacaatgtttcaccatgttggccagggtggtctcgcacttctgacctctggcgatccgcccgcctcggcctcccaaagtgctgggattacaggcgtgagccaccgcacctggcctggttacttaaatttaaatacaaaaattatgttgattaattctgaatgatttcctgattgctccccgtttaccattcacacatttattaaattcttcgcttgccatatagaagcagtctctctgccatatatgccatatagataacagaactagctgtctgcaaaccactgaaattgtgaaaacatctccccttttttcctgtttctaattctagctatgaggattatatacagaagtagtcctggatttgatttttttttttttttgatgattgttttttgatagttgttgactacaaatcatttaaacgtctgaaaggggaaaggttttccttaaaaatggatgacaaaggagaataaaaaggtattttgactatttttttgaatgatgagttttttttttctctttcttgttttcttttggagtcatttatgtgtcactgagtggataccatggaacatgtggcagaagtagatatatggggtaaaagaaccatagttcataagctccttgacagaatcactgaagtgtagccgttatatggccactgtcgcagggggaggcagcagttttgaagaaggggatgagtaataatgagtgataaaaaggcatcctggatagaagaccaaactctgcagaagaccccagtttgattatgcttttgttttctgatttgcggaggagagtgaaaatgcctgaggggtgcgggggagcacatagggtgtatgtgtgtgtgtgtgcgcgtgcagattctctctttcactgtatgtatttgtatgcatgtatgtatcttaggacttaagctttctagtcaataaattgccatagtggggaattgcttaattgcttgccttctgttgttgtatttaatttaattttatttttaatgatttttttggtggggtacagggtcttaactatgttgtccaggctggtcttgaactcctaaactcaagtgatcctcccgcctcgggctcccaaaatgctgggattacaggtgtgagccaccatgcccagcttagttgtattttaaatgggcctgtttgcagcattccctactccccttagtttacctggctcacaacctgtctttccatatcaaggcttctgtcacccctggcccatgtcagtgcatttgggcagcccacccagcatcatcacctcatgtcccagggaacttcctgttcctctcttccagctatttccttccctggcagttgagatagtctctacctttgacctactgttaagctcagaccttctgctctctagttacagcctctgtgctgccagattccctcgctcagttgctttctctagtttgggttttctcctttattcagatttccagctgtttctctcctccccccaccgcagcctcctcacttccctccttatgcatctgagactgtggtcagtcactttagatgctgcctctccactgtacttgtgtccatcttcttacctaccacctctagccctggagcaggctcttcccctgtctttgtcttcctgggcccaggctcctaagcgctgctggaaaaaaaatcccccagtattgagcccctagaaatccagtctttaatcccaaatctgtctcccccagcatctggccatcagatctaaagcttacctgccatcctttccacctcatttctctcacaggggaaaaggagcctttgctcctagagtctgcgctcctgaccccttcccatctcacctgttcaaggcatcttgcaataaggggttggtgactctcgaggaatggatcccaggccctccctattatcatcttatgtatgccagttcaacgttctcagcttcctccagccgagacggcccctccagccactgctttatactctccttctctggttgaaatttttgaagtaaataggtcactctgcccatcgttcatcttccagtcactctgtgtgtttatcttccagggaagtgaggctctatgctaccaagccactgaaataatttttttttttttccagactgagtcttgctctgtcacccaggctggagtgcagtgccgcagtcttggctcactgcaacctctgcctcccggcttcaggcgattctcctgccccagcctcctgagtagctgggattacaggtgcctgtcatcacgcctggctaattttttgtatttttggtagagatggggcttcaccatgttggccaggcttgttggcatgttgaccatgttggccaggctagcctcaagtgatccacccgtcagcctcccaaagtgctgagattacaggtgtgagccaccgcacctggcctgaaataattcttgacaagatctgcttccttgttactaatacagtggatattttgcatcctaattttaatgcagttcagtgtggtagacctgtatttgcatattgaatattcccttccctgttttaataactctattttttccttttcttttatatctcctgcttctctagctagtcctagaccttactcatcggtgtcttctctgtttgttcctcaacttgaggagttcctacagggtttacccaatctgctgctttcatttagcccttttgttctttttgagccatctcattcactcacccaggatgtagcatcggcccttgaattcagtgtgcacacatacactgtgcactatgggacagccttcagaggcactttgttcctgaaattgtggtggtctttgcctctcatggagccttgcatatgctgtttcctctgcctggaatatcctaccttttacttaactgattctcgttcttctttccagtcacattttgtacatttcttctgggaagctttctctgatttcccctttccacaggtccaagttaactgccttgtctaggtcctcccatggccctctgaaggcctcctttcatagcaccatgtctgagtatactgtaataacacgcattgctctgtaatagcctgtttacttacctattgccaagtaatctatcaagtcttataaagggcggggctgcttttgttctagtcatttgtatctcttagtacccaatatagtgtttggcatatagaaaatacccaacaaggccagtcgcagtggctcatacctgtaatccgagcactttggtaggctgaggtgggcggatcacttgaggtcaggagtttgagaccagcctggccaacatggtgaaaccctgtctctactaaaaatacaaaaattagccaggcgtggtggcgggtgcctgtagtcccagctacttgggaggctgaggcaggagaatcacttgaactggggaggtggaggttgcagtgagctgagatcactccactgcactccagcctgggtgacagagtgagactccatcttaaaaaaaaaaaagactccatcttaaaaaaaaaaaaaaagaaaaaagaaagaaaatacccaataagtagttcctgaatgaatagatgagaatgctgtttagaaggttcatgaattggaaaccgtgattgctagggaggctttgagttgatggtattgtgttgaaccatgtgttacccaggatcaatttagattttacactttgttttctctgttcctttttatagtaattttctgtatgtggtgttttccccccatgagattgtataccatttctcagcgagaactgtgtgtaatgcttggtggctccctcatggtgccttgcatggaattggacttcgtttcagtggatctgatcccagttatgttaatgctcgatggagctaagtcttatctcgaagcagtccatgtcttcatcagctggccctgcctccatgccctgcacagaccatgccactctggagaggtagtttccctgtggcttattagtcttatgttccagtgtgctggccaagtatgagagacatcagtggtatgagagagtctctctcattcaaacttcgtaggttttgtagctgggactgaccagtgctgacaggaaatagaggcatttattaaaagccagagatttttcaagttgcaggaagcaaagctcttgttagctatgattttgtggtgggtttggtagtccaatataaaagtaaaaactggatgacaatgggaggagcatgcttgggtctccaaagttagatcatttttcctaagtaatttgtctttaaacttttactggtttggaatttcctgagattttgatcttgccagaaagtttatagcaaaagttctgagcagatgacacttttgcgtctgaaaccaaatcattgtttttgtttttaacttttttcttaatatattatccttagttcagccctgaagattattctgttatttgtggatctcaactttccccccatctcctggatctttgtgaaatgaatggtattaattgaatagagaaggaagatataaacataaacttagtcaaaaacttgttcttgactaggcaagttgggctttatagctttgagctgatgacatgtctattcttgtgaaaaagggatttttagtgttggtttggcttcttgttatatttgatttattattattatcattatcattatttttgagacagagtcttgctctgtcgcccaggctggagtgcagtggctcaatctcggctcagtgcaacctccgcctcccaggttcaagcgattctcgtgcctcagcctctggagtagctgggattacaggcgggtgccactacacctggctaatatttgtatttttagtagagacaggtttcaccatgttggctaggctggtcttgaactcctgacctcaggtgatccacctgccttggcctcccaaagtgctgggattacaggccttagccactgtgcctggctgattttttttttttttttttttttaggtttgttttaactggaactttacgtgaatgtaattgaatttagaataaaagcacttaatttcacagtgtgcagtgaactttctgttacttattttaacagtaaaaccccttgcagtaaatgacttggagcaaagattgcttttttaaaaaatgttttaatttgtttttcttttcttgagatggagtcttgctctgtcaccaggctggagtatggtggcgcgatcttggctcactgcagcctccccgcctcctaggttcaagcgaatctcctgcctcagcctcctgagtagctgggactacaggcacatgccaccatgcccagctaatttttgtatttttagtagagacagggtttcaccatgttggtcaggatggtcttgatctcttgaccccgtgatccaccctcctcggcctcccaaagtgctgggattacaactgctgggattacaagtgctgggattacaagcgtgagccaccacgcctggccaattttttttttttttttctttttgagacagagtttcactctgtcacccaggctggagtgcagtgtcacagtcaaaactcactggcagccttaacctcctgggctcgaatgatcctcctgcctcagcctcccaagtaactgagactacaggcatgtaccactgtgcccagctaattgtttttttattttttattttttgtagggacagggtctcgctattttgcccaggctagtctacaactcttgggctcaagcagtcctcctgccttgacctcccaaaatgttgggattacagggacaagccactgcacctggccaaggattgttttttaagtgaactgagacccagccttattagtggtcccagagcagacctgggacctgaagggaacccttttcttctggtccagcgtctttcctctgatgggctactttcctggagcctttgattgcctgtcatcagagtaactgagtttgaacagagtaggtagttcctctccagaccaccacactcaccagctttcattctgcttctctcgtttagactgtggttctgaatcctcagttctatttactgagtgtttttaaacataaaaatgccttttaatgagattgaaggccagaggtgggacagttgaggacaaagtagaaataaaaccttcaaggcggggttgttggtgggagtctttttttgtttgtttgttttttgagactgagtctcgctctgtcacccaggctggagtgcagtggcacaatctcagctcactgcaacctccgcctcccgagttcaagctattctcctgcctcagcctccttagtagctgggatttcaggctcccgccaccatgcccagctaatttttgtatttttggtagaaacggggtttcaccatgttggccaggctggtctcaaactcctgacctcaggtgatctgtctgcctcagcctcccaaagtgctgggattacaggcgtgagccactgtgcctggcagggagtcttatagaagctgtcgtggacaatgtgggaagtagtgagcctttgtattccagtatgctgggctccactgtgcttgctctggcccccggtcgctctctgtgtgttattgagtccccatccacggccatactcttcgtcctgcttctctccttaccatcctctccccgctagtggtaccacggctaccactagcaattactgacatgtgggatcttagggctacttccctataaggctgcagggcatgtggtgttggctacgcgcatggtaaccatggtagccctgtggttctccacatgtgcgccttgtgacctgggattggctgcagactagtaataaactgcgtcttctggtatggaatctgtctgtagttgtactttctacctctgtatttaaggggagatctgtaacctaccaatgccagttgaagaggatggatgatagagatgttaacaaacagctgaaaaactaactacaatggcctgcaaaatagaacagcaggtttttgtggcaaaactttgtgtccatgagtttgttttttaaatatcctcatataatctgttttaaatcgagaggctttgggtaaaagccatggctagtcttacatgtcatggagtacctagcttgtgaggttcacagtttattatttacagagtgtccccttaaatcttctttgggtcggttcagcgaatgttgctcagatggacttttttggctgacatagagtcaaaatggtaatcaagcatgaaagtacagacagtccttaacgcacaaatgtgtcatgcttgaaaagttggaaagttggttctctggagctctgattgtattgtcctgtagaatccgtgttgtgaatggtggttaaatcccaaatgagtccgtagaacctatataatctgcaatatacctgcagtattccaattaatatgtaattcccccatagaactatgttaatgatttgtatgtatggtatttaatattatacataataatgattgtatgaataaaaaacattctgggctccatgtggatgatggggtgtgtgtgtgtgtctgtctatgtgtgggtgggtgtgtgttcatagatcccttttcctgcaatcctggcactggaattggttttatcatttccaattaagtttcattcccatgaattttggagtacagactgggtccaggtatgcagggcatagattagagccctgagaaataggattaggctggaattgctgggttggagatcagtagcttccaggaacactttttgggcctggctgtcttcattatccccttttgttttctcctggggtctgcaggtattgccctgttttgttcctctaatatcactttttttttttttctgcttttgaccagggtttttgcctctggtctacaactgaatatcctatcagactctcctgattttgaaataaatatatagtttttttgaggtgttctagcgaatttctaaatctaaatgttgtggcagagttattacatactaattttgctatgagaggttgtagaatcccagatgactaatcttgtaaaccatacacgcatttccatctaattctccattgtatatcatgttgcagaaaataacagcctctagagtttacattgcctcctttgactatatttcttatttaagattagttttcagataagaccttttcatggcagtacataactgtacagagggcttccaacttgtcttgggagctctcatctctgggagacatcacattacccactgccccctgccccccgcccccagcctggatgcactcagcctgtaccccatttctgtcctcagccaaacactgctgaaatgcaagagctttcaattgctagccagtgaagatgcagactaagggatttccatgtagaagcccgctcttttcagctggctcgtcgagagctggaggccccttgcttgttcacatgaggctttttgtccctgacttggtggctgctgtttcacttctcagcagaaagggacacccttgcccccccccagaaaggaagatttgatgtaccacttccgaaaggttcagtcgggcatcactgtaaccaagaagataggtcaggtgaggctggaggtggaacagggctgctcgctagaactccagattgttccacaagtgccttctggcagagaatgatggaagcttccgtgatttttttttctccttaatagttatgagcacagaagaggagcagattgtctggctatagaagctgtcttattttttatttttgtttttgagatggagtctttctctcttgcccaggctaaagtgcaatggcgcgatctcggctcactgcaacctccgcctcccgagttcaagcgattctcctgcctcagcctcctgagtagctgggaattacaggcatgcgccaccatgccagactgatttttgtattagagacagggtttcaccatgttggtcagtctggtttcgaactcctgacctcaagatctgcccacctcagcctcccaaagtgttgggattacaggtgttagccactgcacccggccgaagctgtcatattaaatagcactttctgcttttagcaaatttaatccaaatgagactttagattttcttgctctgacttaccagcagttccttgaaacacatttaattatttttgccagaaaatcactcaagcacttacgccatttttttaccgtgaaaatatgctgcattattttaaaatatattagaagtcagtaaccataagattttatatgttttctaatgtattctgtaagctttctgctgcttttgtttggaaggtgtattttgtaacgtagaggactgctttatctgcttgtaagcttgatttttgtttttactgtaatttttttttcttttgctgtattgagaaatacattgagtaattataaagtcagtggcatgtttataagttaatatttgtatctattccttagttactctaactcaaaacctaaagtaatcttcaactctaatttactctgacatccagttgactgccaagtcctccaacttaatccttatccttttttttttaaagagatgcagtcttgctttgtcacccaggctggagtgcagtggtgcaatcatagcttactgtaacctcaaattcctgggctcaaatgatcctcccacgtcagcctctggagtagctggggctacaggctcttgctaccatgcccagctaactttttatttttattttttatagagacagagtctcactgttgctcaggctggccttgaactcctgccttcaggcggaactcctgccttcaggcggtcctcctgcattggcctcccaaagtgctggaattacaggcccaattttattcttgggatgtatgtctgaaactctttccttcacttccttcccaagccttagttcaggcccttctcatctgtggtcttcaaagtcgccttcagctggttcaggtccttcctttctgctgtatctttcatgggaggacatgttatgtatcactgtcctacttgaaaacttccattccccattgatgagggtgttacctccagattcctaacacaggtgctgaaggcatgcctggataaaggcactcccttgatctcctggccaggtccccgtacacctgcagcgcatgctccacattctgtctttactgatgctgtgtcttctgcctgcggagccacccaccattctattcacagcccctgcctcagcggagcacgtgcctccctcttcctacactgagctgtcctttctattgaatcccctcttttttgtagtatgggaaatattttattatgaatactcttttctctgttgcctccgtgaccacgttaactttgccctaattcgccttaggactccatctgcttaggggaaagttaggatttggttacagaaagcaagctgctagaaagaacagtgtttagcttctgacaggcaaaataggattttgcaacatgcttttcctttttaatgcttagacattttatatgaattaatatttttatttggttgcttatacattactttctttttagctagaatgtgaaccctataggaacatggggattgcctttcacatctttgtatcctcagtacctaatgttcagtcaccctgtggtcttgtgtcgtatatacatttagccttccttaattaaaccatatgtactggtccccgtcccccacccccaaatagagagaaagaaattccttgaatactacattgccagtatcaaaccacaccttgatatcctctggggaaagggaggtatcagttgaaaagagaaaagaggttaaaatctaggcattaaaatgtgtaaggcttagatgctggcaatttaaggtatgttttcctgaggttaattttgattgtgtgcaaattttacctcatatctaactgtaggatttagtcaccacataagatgggatacctccataaatccttcagaaatgtttgtgaaattaaataaagccttattgaagactcagctcttgagagtcatctacctacctaacagttattcttgaacagaagagtcttacttttccctataaggcagtgtgatagccatctgtatattcatataatttatgttggcgcttacttcatttaaaaatgtattccgtgaatgcagttgccaggcggtgtgctgatcagaaacgtgtaccaatggcctcttttataattataagaggaagaccaacctgaaacagtcacacaaatgattaattttaattgtggaggagtgctgggaaagaaaaataaaagatgcaatgcaagtgtttacaaaggagctttgagcttgtttgaagtggtccttgggcacttaagcaaggcttaaagaatgatgtgattagaagtggcttagcaattctaaagaacacagggaaggcgtgtggccagaacattggtccctagagcacatcgcctcctgacataccatttccttaagttaatgttttaccactatacataggccctcccctttgtttacccagatttttttaattttaaggatgtttttaataacttagaatcctgtaatttgttgaacagtcctgtattccctttacttatattccttgagattttataaaatattttttacatgtcccaagtcttgattatatctttttacctcttgttaagaaatacttacttttctatttttatgctatatttcatgtttactgtagaaaacaaaaaaagtaaaatttttctttattcctatcactgcagcttataagcactctaaacattttgatctatattttgccaatcatatattttagttaaaattgttgttgacataattgtagattcctgtgcagttgaaagaaataatacagagctgagcgcggtggctcacgcctgtaatcccagcactttgggaggccgaggcaggcagatcatgaggtcaggagtttgagaccagactggccaacatggcgaaaccctgtctctactaaaaatacaaaaattagctgggtgtggtggcgggcacctgtaatcccagctagttgggaggctgaggcaggagaatcgtttgaactccggaggcagaggttgcagtgagccgagatggtaccattccactccagcctgggcaacaagagcaagactgcatctcaaaaataataataataataataaataaactttaaaaataaaacagagagatcccatgtgcgctttgcctagttcccccatccactgcccataacattttgcagaactgcagtacagtatcacaaccacaatactgacattgatacagtctgctcatcttattcatatttccccagtgttactcgtatccacgtgtgtatgcattgtgttttcaatactcttttattataaagctgtttttaatgtgattcaattctaggttgttttgttctgccctcaaaaagcattccctctcctaatcatatctccgtcatacccttgtatgttttctttaaacctgttttaagaaagcagctacctgtaagagaaatgagattgaaaacagaattgccaatctgcttgtactttataagcctgttgattgtttagatacggtttagccagtttatagttaccctgggtgctgaaaggtatgctggatgatacctaaccaacagagaaccattgaatgccgttcaaaatggactgaagcatcagcaatgtctgaaaaaggcctgacagtaatgtacatgtcaaatggcccgtaatttaagcagagtagagtaagtagaagaataaacatggggaaagttccagcaacagaggaggctttgagcttttgctcttcatcttgagtggatgttgttctcaggtggtaataggccatcgagctttctccactggctgcctctctggggaacaaataaccgaaaagatactcagcaccctggttggtacataggtggtcagttgatttatacttcctggttttcagtgttgcttgaattttctaaatggaaacacagtacctttataatcagaaaacaatcccgagttttgatttgagggtgttgtaaaaagttaaaaaaaaaaaaacagaaatgtgaaaaggaagttgtgttagagtatttggagttgagaaagcatgaaaaggacagaagagaagctggttgtcaggttgcatggggtagctacaagcacactgaccagaaagtcagctggaaaaaaaatgtagaaacaggagataaaacggccaaggggctatacaagcaaacagcaaggacctgagaagaaaaactagttaggtgtgactgtcagagtgatgtgtacagtgtgatcctttctgtgtaaaaacaagcagtaagaattcgctgtttacgtttgcgtgtgtttggagaagagtggggaagagtaggcactgccagactgtgaacactggttaggttattgttatatctttgtattatatacactggacatgttatttgtataatatgagaagaaattttataaatcattaaatcttttggcatttaggaacatttgtgttttctaatagttgcttctatactattatctttattatatgcccttcatcttctcagtgtttggctgttgttgtgattcccttttgtgagcagtgttgaagttagctaatattcatttcttctcccttctttcaccctcctccagagtctgatttgaagtattcctagctgctacctataaaagcaataagcaagattgttttacttttcacaaactcgtcctgttctgtgcctctgcctcggacatagctgtagtatagagtgttgtctcccttacatccttctatcttagacctactagtaaatattaatgctcactctaagttcttctcaattcttttttttttttttttttttttttttgagaaagagtttcgctcttgttgcccaggctggagtgcaacggcacgatttcggctcaccgcaacctccaccttctgggtttaagcgactctcctgcctcagcctcctgagtagctgggattacagtcacgtgccaccacccctggcaaattttgtatttttagtagagacaaggtttcttccatgttggccaggctggtctcaaactcccgacctcaggtgatccacctgcctcagccttccaaagtgctgggattccaggcgtgagccaccgcgcccagcctcttctctcaattcttcctgaagctctttctgcactagattcctcaggaagggcttgtgggaacaatcttctgtgaatcaacagtacatattcataatagtttgtcagcagcctattattttaaggccatttggtctgtatataaaaatgtttggatcacattttctttctttaaggtaaatatgttattctgttgtcttctggtataaagcattgctgtaaatgtttgacagtctaattatcttttgcttataagtgacttagggttttttgtctatgtgcccaaaggattttttccctctttctctctttttttttttttttttttttttttaaacagacaggatctcaccctgttgcccaggctttagtgcagtgaggcagtcagagcttactgaagttttgaactcctgggcttgaggaacaaaggatttttttaaccttttaattcaaagtctcatcatttatgcaaccatgtcttggtgttggctgttttgggttgttctccctcaaaaatccatgtgctctttcaatatgtagttttaaatcttttttttttaatttcaggaaaatcttgaattagagttttccgtttttcgtctggtacattgcttgggtttccttcttcaggaactcagcctgttatgtgtatgtttgatcttctttgcctgtcgtctgtttctttcacttcctctcacttttttaaacttcatttattaaaaaaaaatttttttttcgagacagagtttcgctcttgttgcccaggctggagtgcaatggcgtgatctcggctcactgcaacctccgcctcccaggttcaagtgattctcctgcctcagtctcccaagtagctgggattacaggcatgcgccaccacgcccagctaattttttgtatttttagtagagacagggtttctccatgttggtcaggctggtcttgaactcctgacctcgtgatctgcccgcctcagcctcccaaagtgctgggattacaggcgtgagccactgtgcccagccttattaaaaattttaaaaacatacatttaaacttaacagaaaaattatgagagagaagggggtggtgccaggcttttttaaacaaccagctcttacatgaactcatagagtgataactcattaccatgaggacggcatcaagccgttcatgaaggatctggccccgtgacccagacacctcctactaggtccatttttaacattggggatcacatttcaacgtgagatttggagggggcaaaactacaaaccatgtcactcagggattggaggagcaagtaccacctatactttggactcaggtagaaaggcaaaatatccaggaaataagctgctaccgtccagggttcagcagaggtgcccatcagcctgccaagtactcaagagtccagcctctagggagctaatcatcatggtgagctcttcgaggcacagggagctgggaagacagtgcttgccacccctgcctgaatagtgtttgcacagagagttctgttgtgtcttgattgggtcctcctgccactgggaatgctgtggattatactaggtctctatctggcttgtttcagggctccatgtgaaaaccttcttgatatcctagccatccacctgctcagtccctagtttgcaaggaggctgtggggagcctagattctgtgtcagatagaatgtactacattccgtctcaggaatgtaccacatcagaaaacagtgcgacctgcaggagaagtagaggtgaagaggcacattcttccgagaaatgtttctctcaacacccagcattccctggatatcagcaggaaattactcactgctagaaaatgccccatgagccttctgttaaggaggtcaagggagagaacagagaaagttctcaaagttgacttggtcactggtactttcttatgcggttcttattttgtttgccatcgtcatcatcatgctatgtctattttctcaatccaaatccactgctttcaccttggttctttctgaccggtttggcacactcattcagtaaatccttatggagagcccaatgtctgcataattgtgctgtgctgatgaccaagctagacctacgagtgtcggctcctttgagatgtacgggacagctcttctgtcatctcttctgggaagcctctccaggcttggtgaacagtggcaagatgtttaacagttgtacatgtgtcccatgttcctttctaagagcctgggcaaaccagacccggtcgcaggtcatcgtagtatggcgtgagcttcctctctcctttctgaccttttgtgtgatggcaagaacctgcagagtgacacaagcagcaggcttctgaggttgctctagcctcagaatggccgtcccttctccaccctggccctcattgctgaggtttcctttgaagcaacagtgccggaacagactaggggaagcagcttggacatagctgtatgatttattaccacccattgaggccaaccaaagtcggcaaggagaggtagcaggtcagtggtgcctggaagcttcctctttcctttgcaccagatgtgactgctctgcaattactcctaaatttgctactctcgtttttactagccaaccttgatgtttttcccttcttcctgtagaatagacttcccctctgatcagtactttctactcaacactatttgtggccacagtgggaactcattgaggacagggaccatgacattactacctgacccatcaacacttggcataacttgaaatgcaaggacaaaaattggctgcaagtacaatgtggtcttcactctgaaggtgatccttaaaacttggctttggcatcatattgccttaatatacctaggggattgggtaaaaccagttactttaaaagagttttacaattctggccttctagctatcttgtcttcttaaacaagagcacaagatgaatgtatcttagtgaaattttatatggtttgctttgagtaatcttgcgaagattgatttttagcacagtaggaaagacacattctaatagtgatttttttccccgagtttatgtactgctgttgcatgaaaatctgactagatttaatgttcctaaagttctttgttcatcctgatttttgcaggtcctagggaaagctttgttttcctcttaacctaacttagatgttgtcatttcatgagctttggaggaagagtgtatagccaattgtgtaatgtctttaaaggatattatctctgcaatagttgtttataaggcctaagttattcatgtaataatagtggccccggatctgtttctagcaataggtatatggattttggttcctatatagttgtagttgtggctttgagatattgagcaagcccttttaagaaaggatttggcatccctcagccttcaaaagcttctcaaaattgatcatatgttattagcaaaggtttactgcctgcttccattgtatagacaatttattttttatgtattccgttctaagaaggcagatgaccaaaagatcttgcatctgttgcccaaggcttgtgactagagaggaaagagataagaatacttttttaaaatcccattttactaaatatgttgaggaagtggtaagatatattaatttgttgagatttttctgttatgcctattatatgaaataggtactctgaacatggcttcttaattaaatatatttgataaaatacaacttgcttcccctggagtttagaagtcagataactgccatggagagctatgctttctttgttttaaagatctgcttatgaacatgataaacaggaacaatttaatgttttcaatattttcttgtattttactgcaagtttatacacaacataaatatgggggaagggggaaatgtttataccagagccatcctgcccattctttccttacagaaggacaaaggagcagtatttattttaactacaaaaatactattgtaggttttaaaaattccgtatattttgatatcttgtgttcctcttgacctttaatttgctaaatagttgcaaagaatgaaggtaacctgcatcatcttcttaaaaaccaactctatctaattataatagtttgtctatctctgaaaaatagtgatgtgttcattctgaaatcagaactaccggatgcagctgcattttgttactatttgaatttcgggagagggaggaggatgcagcctttcgagctgctgaaatacacaaacacaaagaagacaccaagcatagtagaactgtgttaagctgaccaagccagaagaagcacctattctcagcatagtatgagacgtaaaggcaatataatgggcatagttgaagatggtagaaggaaaatagactctgatggtttaatgttaaatgctttttttaaaaaagtggtattccaatatcgaagaagaagactttctacttttagaagcaataaaggaaattgcagaggaaagggtcaataggttggaatacataaaaattaaaaacttttaaactttttttttttgagacagagtctcactctgtcacccaggctggagtgcaatggtgcaatctcggctcgctacaacctccgcttcctgagttcaagcaattctcctgcctcagcctcccgagtagctgggattacaggcatgggccaccactcctggctaatatttgtatttttagtagagacagggtttcaccatgttgtccaggctgatctcaaactcctgacctcgtgatccgcctgcctcggcctcccaaagtgctgggattacaggcatgagccaccgcgcctggactaaattgtttcagtattaattttttttaaaacaagatcttactgttgcccaggctgaagtacagtggcccaatcatggctaactgcagccttgacttctgggcctcaagggatcctcccacctcagcgtcccgagtagctgggaccacagacatgtaccaccacacccagctacttgttttatttttatttttgtagagatgaggtttcaccatgttgcccaggctggtctcgaactcctgggcccaagcaatcctcctcccttggcctcccaaagtgctggtattacaggtgtaagccattgcgccctgcctgattttttaaatgtgcaaacagataagttggaaaagtgatttccaataaagataaagagttgatggttttaaaatacgtaaagagcttatatgaatgagaaaaacactaacattccaaaagattagaaggcaaaggacagaaagaaacaaatcactatgtctgggaagggacatgaaggagcaggttcccactgggccagcggggctcaaacccactggggacgtccgagagactgcaagggccatgccttcacattgccgtacctgagaagcaaggagctggggtatttatctctttcacactttgggaggctgaggtgggcggatcacctgaggtcaggagttcgagactagcctggccaacacagtgaaaccccgtctctactaaaactagaaataattagctgggtgtggtggcacacacctgtaatcccagctacttggaaggctgaggcatgagaattgcttgagcccaggaggtagaggctgcagtgagcataaattgcaccactgcactccagcctgggtgaaactctgtctcaaaaagtaataataatcatgataaataaaataacattagattgttagcagaagtagccacaggtttctcccacctctctgcaagttgctgagtgtgattcccatcaagaggtacaatgtctttttatttttattttatttattttatttatattgcctatgttgtctaggctggttccaaactcctgagctcaagtgatccttctacgtcagccccccaaagtgttgggattacaggcatcagccactgcacctggcccagatactttttcttgagtaggaatttcgagtcaccctgaacattgcatgccttcgtagtggggaagacaataggaaaccacaggctgtaggctaaaatgggttgtgtttcttgtaacgtcatgacaaggcataacccatcttggcatagtaaatagtaagcactcactgaactgatgattttaaatctttgctgtttattcagcaatatcctaaattagcgctatgttagtggagttgcatctccctcatggattagtctgaaaaagatgagaaatctgtatgtagaccaagttatccttaaactgctcataatgtatgatgcacgtggttttacgtgtacagcctggtaccattgttcttaggcacatttcagtgccagaactcttaatacccaggaagaagcaaaaagaaagatggaggtgcagctagaggttgtggcctttgaacgattcattctgccttaataagagtggtctggctgagctcggtggctcacacctgtaatcccagcactttgggaggccaaggcaggcagatcgcttgagcccaggagttcaagaccagcccaggcagcatagcgagaccccccctccccccgtctctacaaaaaaatagaaacaatgagccaggcatggtggaacgtagtgcgtggtgcctgtagtctcagctacccagttggctgaggtgggaggatcacctgagccctagaagtcgaggcttcagtgagcccttattgtgccactgcactccactctaggtgacagagcgagacaggtcctgtctcgaaaagaaagaagaagaattaaaaaaagtgattagatcccttgtgtttgggacacttgttggcagcagggatggtagcgtttatgagggttgcatgtaacatcgcctagctcagacatctgtttgactgtcttcccccctgaagcgcaggctctgtgagggcaggtcttttgtctttcttgttaatcttcatatgcttagtgcttgccacatagttgatgctcagtcgatatttggatgaattgaagggattaatgcattgaatctgaaccttgctttcttaatgcatatggggagttctttggaaagccacacagaggagcttggttgcctgcttcctctcttccccagattgtctttttattgttgtggcttcactgaagcactctcacttcaaataattttgggcattggtcgtattttattctttgttccttcttcatccttacccctcagatggtatgtagaaaagtacactacatctagaaagtactttataaactcatttggttgataataatacatatgccttttccttggtcctggtagcagaatcttgtgccactcttggaatacaaacgaaattcttaaccaaagccagtttcattttgatgttctattttcctcccattcacactccaaattgtgcaccaaagtatcatcctagttttgtgaggatggttctccatacttcagggtaggagtatcatgtggattcctatgatacctttctccctgggaccatggagggcagcagctggtgattgatagtctgattcccggtgaggaaagctgtgagccttccacttgcagatgtctgccaactacatgtgtccttagtcaactgtaccactgtcctccggcaaacagcagaagcccagggcctgaagttcttaagctgtcattatggaaagcagaaggtaaacaaaacagaagtgaaagtagatttaattttttagactgttctcttacaggaatggttttgtggttctcagcattttaaaaaaaatagtggttccaatatgttttattgacatcaattactgtaagtctgattcattttctgcctattgatttctacccaaggtgaaattcatgacatttaacagaaagcataagtgattttttaaaagcagacactattagggacggtaaaaataagatttaaagtcgggacacttgaaaaagcaatttttatacctttggtaacgattctattctgattctttgtataaataatataaacaaaggctctagaagcttactataatgaagttggtgtgctgtttctaaattctggtttaaggcccaaattcattttatctgcattaacttttttttttttgagagtctcgctctgtcacccaggctagagtgcaatggtatgatctcggctcactgcaacctctgcctcccgggttcaagcgattctcctgcctcagcctcccgagtagctgggattataggtgtgcgccaccacgcccggctaatttttgtatttttagtagagacggggtttcactatgctggtcaggctggtctcaaactcctgaccttgtgatccgcctgcctcggcctcccaaagtgctgggattacaggcgtgagccactgcacccggccgtgttaaaatttttcagtggtagaccactatgtcaatatgttgctttcactgacaacagtattttcttaaagataggataccccatttctagatgaatctcattctagctggaaaataatttttcagttctgaaactacatcaggcctcagggaatcaaaactagctattagccacacacatataaagtggctttgctttataaacgatttagggtcaccatcaatgacaatggtccctttttattgtatttttaagagtttcttatcttaaatggctgcataactgtagagttttaaaaaaattaagtaaatgaccatgttaatgctctattaagcttccaaacaatattgtaatttactttgaagatttttttttattctcaacatcctgcagcttgaccgtttgcctccgtgtctcagtgctgcttattttgaggtgtggactggagtccatctgtcccccttgcctctgaactgctccgttttgtgtttcgtaattcttcatgctgcatcctgggcgcatttctctgtagtagctttcaatttgctcatgctttgactgggcttagtctagcgtttatcctatctcttaaggttttttaaaaaattttcatgattattcatttatttccaggatttctcatttcttcagtcacatctccttgttctggttttacttcttcctgtttttattcataacatcttttttatacacgattccttcatgtatttctaatcttaagtatatttaattgcttatttgattcttttttttttttattgagacagggtcttactctgccaccaggccggagtgcagtgacatagtcatagctcactgcagcctcaactacttggactcaagcgaccttcccacctcagcctcccaggtagctaggaatacaggtgtgagagccgccacacccagctgatttgtcttactatgttgcccaggctggtcttgaattcctgggctcatgtgatctgcccttcttggcctcctgaagtgctgagattataggtgtgaaccactgcacctggccaagtatgtttatttatttattctaatttgagagggagtctcgctctgtcgtgcccaggctgtagtgcagtggcacaatcccagctcactgcaacctctgcctcctgggttcatgcgattctcttgcctcagcctcctgagtacctggggttacagttgcgtgccaccacacctagctaatttttgtgtttttagtacaggcggggttttaccctgttggccaggctggtcttgaacttgtgacctgaagtgatccgcccgccttggcctcccaaagtgctgggattacaggcatgagccaccacgcttggcccaagtatgtttatttttaaagtccccaacaagctatacaataaattgcatatggaatggatttttgttctagttgatttgttggttatcatttgtagaactaactagttgtcttctgtgtttgataccttgcttctaggtcattttgagttgggagccttttgttttgtttttattctcatgctgtttttgagcctagctgtgcctttatggttttctctaaatttaattgaccattgttttatatttggagcagtgggtgtacatcagagtgtgaaagcagccccaccctctccaccagaaggtctccatgccagtttcacgaagcatttttcatgccctcattcctgcccttatcccttgatttgtggggagtttgtaaagcagttgattgttttttttccacgtagttttccaagtgcacataattgttctgttagtgacttgtagctccattatctattaaccttgccccagaccactgtacaagcggacccaacgcttcctccagctgtggcagggacagttacttggtatcctgctgccttttcaatgctgaccagttttgccccttcctcccctcaacccctgtctttcattcaactatcaccaaaccaaaagattctggtttgctttttagtatgtgttcttattcagtacatagtcattttaaaatttaaaccaaaacagacttggtactgattagcttaattttaagctttttctttattattaaacagtgtagtttatcttagcatttcatattaagtatatgatttatttcatattgcttatatgaatgtacacataaatataataaaaatattttcctaaggtttttgtagtaaattatatcgtttcattaactttcatatatagcattgcttttgacctggaagacattgaacctctgatgatttgtatattcctcggagtatactttgttacatagaaattttctcatttataatgagatttgtgattaacaaaatttgttcaacatgcattactttgaagatctggtttctaaaattttatgctagttaccccacccccccttctatatatatctccctattcagcgactactgcaagagttccaggaaatgtacactgtgtgttcacttactgcattttaaatcattgcctttactatatttctgcatttcccttcaatctagctctgtctgtacatttctgaaagccagtagcttccctgaagaaccaggtaacaacccgaacaatcaaattagataaccatttgtagaatggaggttccgggagatcttagaagatgtgatgggtgctaagggactttgtagttccctgaagttccagtgagtaaaaggtacccttggaattttttattccttcagacttttaaaacagagatcactttcaaaaattactctttctgctttgaatccatgttttagtaactattttgacactgtttggtcagaaggctgtgtgggtcaactgcaaataaataaaataaatgtgatttcagtaatttccattttgtaacaagtaattgagaaaataggattggatcagatatttgcttatacacattccctttcaggagcacttctgttctataaagaatgttggtatattgttaaggacacttcaagctttgggaacctttgaagtatccattgattcagttaacaaaattatgttgagtgcctaccctgggcctgggcctgtgttaggaggggacactaagatgagagtccaaagcacttcttctcagactcctggctgctaatgggttgctgcctctacttcttcacttagcagatagctttaaaatgagtaatgcattttaccatggagcccgtaagagacattcacccagttgtggaccgaggagaagggtgttaaacccagattgtgatgtttcacttgatgaagtgcttaatataaacatggaaatatttccgcaaggataaactggcttttatgcctgtgtgttttcaggagaaatagaaatctctaatcaaatattgccagcttttcacccaagtttgactttttgcctaattgagtttgggaggtgtctgaataatggataatgagctttcctgaataaatataaaaattaattaactccaggctctaattcattctgttaccagagttttgtaagcatgttacccctttgtgttcattgggagatcatctgttaccttcttaaatgagtggggaaggatgggaaatgaggaagagctataaaaactattcaggtgaagaaggtttctgcccctccttgccccttttaaaatctccagctcagcagatgctttgtttaaacttgatcaagtgcttgtgaatcttcctagcctagctaaatcataactttggaaggacttgcttttttctctcatgacaatggtttaccacagaaatgattcagatcactttgtgtgcctgatgcctatgtaaaatgatacagtgaaatggaaaccatttacctgtaagctttgggcacacccaagcctgcttcaggagcacatgatcaggcgtgcactctgggagagccgtacacatttgacatctatgatgtgtggcgttttattctatcacatttctgaaatctacactaagagaaaggaggctcttaaaaaaccactgaggtgtggactgggggaaggagagatccgtaaagaacctgtttgttacctgttgatactatttcccattggtaaaatttctaatttagtgtgatccagccctgaaatgctgaggcacacactgaatgactcctgacatctttagtgtttttgttcaggggactcttctgggaatctgtttcatggcaagtttattattcccttttggtttggctcatcagtttacccagcagtcatcttaatcggttttaaaggcttttattttattttgttttctctgtggaaattttacacattcagtagattagaagtagttatttaatctttggttagcataataaaagatcttctagggacattttttgcttgcagtggaaggctagttaaatgtgttcattagtcatgaatctgctttttctatagctgttggaaacgtagctcccctgtgatacagttgtagaatacagaaatctcgttttgctgttacggtacggtagtctacttactttcttccaaaccattaatgttatagttacctttaattgcgtaggtcctatcacccctcaattttaagactctaagcctggcattttatcttacaaaatgaaatataaagacttgtactcagagtatgtgtgtgttttccatataccattctaaagtagagaaagatgagggattcgccagaaactgatttctaataaattatccagaaactgaccccttctcacctcttctgttactgtcactgtggtttcagccacagcatcctttgctgcattgttaccttagtttcctgactgtatccttccttacaccattgatccctgcaatcccatctgcgcgtagcagccagaagggatccacttactgctgtgatcagaaatcctcagccaggtgcagtggctcatgcctgtaatctcagcactatgggaggctgagactggagaattatttgagcccaggagtttgagaccagcctcaaactgggtaatataatgagacctcatctctacaaacaggaaaaaaaaaattttttttttttttttaactagccaggtatagtgctaatatacctgttctgggatccagcatgctctccctgacctgcagcttcatctccaccactttgcccctcactcccaccacaatggctttcttctcttcctcagacatgccgtgcgtcctcctacctggaatattcccctccaaacattcccatggctcactccctcaccttcatcagatctctgttccagtgtcacttttactggaaggtcttttgtgaccatcctacttattataaaaaaataatctgcccaaccttctccttttatttcctctacttgatttttcaatttagtacttatcagctgacatatattttgtctctctgtctctctctgtctctcatagaaggtaaattctataaaggaaggaatttttatgtttggttctttgctgtagctccaatattcaaaacagtgcctgacacacagtaggccctttatatttgttgaataaatgttgacactctgatatctaatttttgtctggtgactaatacgaaaactatagagtgataataaaagcattaccttagtagactggaaagggatgagcgctaggatgaactttctgcctggcgatcttgctgaatttaggaggcagattggggttcaaaggaggctgaaatggctaggatttgcagagcagggtactaaggatgagcaggctatgacagaaagaactccagaaatctgcaaagggatcaccttgagtctggctggatacagtgtacactttgtagggtgtctcttcatgagcttggataaagaacaactgttggggagtggataattcccagcactcattcaagcttgcatcggccagaacggagagagacagacctctgtaatacgtaggatatttggtagaaacattcaaccgaaaaccatcagatatgcaaaaagtaataataataagtaaacaatgtgatgcatagctagaagaaaaatcagacattagaagcaagcccagaaatgacagatgataaattagcagataaggacattaaaacagctattataaataacttagcagatttaaagaaaaacaacataatgaggataatggaagaaaaacaaccgaataccatttctaaagaagaaaaatacaatatctgaaatgagaatttagctggataggattaatagtttaggcactgcagaagaaaaaaacagcatctatatgagaatatacccaagggaagtacagagaggaaaaaaatgtggattggggggtgcctcagtgacatatggaacaatattaaacaagtctgcccccaaaatacttgaaggaataaggttcaagttttttccaggtttaatgaaaactataagcctacagattcaagcatttcaacaaaccttcagcaaaataaacaaaaccacagtaggcctggcacactgtctcatgcctgcaatcccagcactttgggagcctgagtcaggaggattgcttgagatctgcttgggcaacatagccagaccctgtctctacaaaaaataaaatgaaataaattagctggatgtggaggtccacacctgtaactctagctagcctggaggctaagaagggaggattgcctgagcccagtagttcaaggctggagtgagctaggactgcatcactgcactccagcctaggcaacagcaagaccacatctctctctctctctctctctctctctcaaaaggcagtgaaataacgacttatttggggaaaaaataaaggcagagaatttgttgccagcagactagcataaaaaaaaggaagtccttgaaacagaagagaaatgataaaagatggaaatttggatatatactaaagaatgaggattgctaaaagtgacatacatagataaatatgaaatatatttttattttaaaatttatttaaagcaaaaataaaaatacatcatatttataacatagaaataaaaaatgtatgataatagcataaaggataagtggacaaatgctgttgtcgtatttttggtaaaatgcactattatttgaaagtagaccatcgtgaattcgatgcatattgtaaaccaaatagaacactaaaaaatgaaaataaagagatatggctaatgtgccaatggtggagataagatagatgcaaaaaaagaaaaacattcaaaagaaggcagagacagaggaaaaaaggaccaaagatcaaatgagtcaaatagaaagcagctaaactagcaatatggcagatttaaatctagccatgtcaatagttatattaaatgtaaatgttctaaatacctgaattaaaggatgaagattgtcagattagattgaaaaagcatgacccaactacatgctgtctgtaagaaattagaaaaagaacaaattaaatccaaagtaagaagaaaggaaatagagtagaagttagtgaagtataaaacaaagagcaaagaaaatcaattaaatgaaaagctggttctttgtaaagatcagtaaaattgataaatttctagctaaactggccaagaaaaaagaaaagacatacaaattaacagtatcaggaagaaaaacagagaattcaaaggagtgtaatgcaaactttatgctagtaaatgcaataagttagatggtatggaaaaaaatgtgaacaatacaaagcagactgtggttgcctttggtggcagtagcggggtgggagtggaaggttgaattgactggaaccagaagcacaagtgaactttttggggtgatggaaatgttttgtatcttggttgcattgatagttaaatggttgtagacattgcttaaaactcactgaacacttaagtgggtatgttttattatttgtaaaatatacctcaaaagcagttttaaaaatgtattcaagtacatacttaagatctttgcattttactctgagtataccttaattttaaaatctgttttttaaaaagtattatgtagataccttttattttcccaatgtctttattaaatgacatctccacgttttgcttcttacctctatttttttttttttatttctctgtctctcaggcatgcacacacacacaccaaaaaaagtacatatgcataatccttttggctgaataaaatcagttgcaactgttatttcggcccttatttgctccgggtaaatattcgttagctgagtggtttatctgtatcagatatttcttacatcttcatccagtcacaccagctggactgaccagattgtttttcacttcaagggcagaatttgtactcactgctgaatgcttccaaatgatacgtagaataacaaatttaagacttagatttttactttttcaggtctttttttttttttctgtgctgtatagcatttccctgaaagcttaatctcatctgtaagtgatgcagtggatgtgttactattggattaatttatttactcttaggtaggtttgtaatctgtcatcatgctgttgtttttttgtgtgggtttgtttttggttttgagacagggtctcactctgctgcccaggctggagaggctagagtgcagtgatgtgtttatgggtcactgcagattcaatctcctgggctcaagtgatcttcctgcctcaaccccttgtgtagatggaagcacaggtgcacgccaccacacccggctatttttttaaatgtattgtagagacgaggcatcatttttttgcccaaggctgatcttgaactcctgggctcaaacaatcctcccacctcggctcccaaagtgctgggattacagatgtgaaccaccactcgagctccatcattctgttattagttgttctctagtatgagtcaaaaactcttacctgcccttttacagttttataaataagtaagcagaatagcagaatgtggacattttttaaatccaaattgaatatgcacatgactcaaggagtcaaatagtaccgtaatcggtttatgataaaatccagtggtttggctgggtgtcgtggctcacacttgtaatcccagcaccttgggaggctgaggcaggtggatcacctgaagtcaggagtttgagaccagtctgacctacatggtgaaactactaaaatacaaaattagctgggcatggtggtgcatgcctgtaatcccagctacttgggaggctgaggcaggagaattgcttcaacccgggaggcagaggttgtggtgagccgatatcgcattatttcagaacaattttccacaagatcagtgagtgctgtccaatagacatataatacaacccacatacatgactttacattttcttgtagccatagtagaaaaggtcaaaagaagcagatgaaattaatagcctgggcaacaagagcaaaaccccatcttttaaaaaataaaataaaatatggtggtttgctgtccccacctcagaccatttctctggtctttctcattgaccaccactcccaatctttgttctgctgattgattacagcttgtatatatctccatatttctaagcaaaatgtttatcttttttaaatttataaattctttttattatttttcagagacagggtcttaactctgtcgcccaggctggagtacagtggcaccatcgtagctcactgtagcctcgaactcctgggctcaagcagtcttcctgcctccgcctctcaggtagctgagactacgctacaggcacataccaccatgcccagctcaaaatgtttatcttttgatacattattcgagaccattattaaggtggatgatttagttttcttaaacagccatcccctttcttttcctcccctctgcttcaccgcccccattttcccaatgttttaccttttggttaaatcagtactcattgtttacattatttgcctctgcacatagtcacagatagtattgtactgtactgtactgtgtttcttttttaaacattatttctgttgttaataattgactttttaatttttttcctattttgttttttaaagagatggggtcttactatattgcccaggctagagttcagtggctcttcgcgggcatgatcccactgctgatcagtacaggaatttccacctgctccatttccaacctggaccagttcaccccttcttaggcaacctggtggtcccccattcccgggaggtcagcatattgatgccaaacttagtgcggacacccgatcggcataacgcatgcagcccaggactcctgggctcaagcagtcctcccgggctcaagcagtcctcccacctaagcctcccgcgtagctgagactacagacacttgccaccacaccaggttaatttttgtgttttttgtagaggtggggttttgccatgttgtccagactcatctcaaacttctcagctcaagtgagcctcctgcctcagcttcccaagtagctgggattatagacgcatgccaccacaccccatgataattgcctttttttttaatttgcataattttctttgtagcttttgctaatgttcccatatcttcttatagccttacagaatgattttccacaagatcagtgagtgctgtccagtagacatataatacaacccacatacatgattttacctttttttgtagccatagtaaaaaaggtcaaaagaagcagatgaaattaatagtatcttttacttaacccagttcattcaaaatgttatttcaataaatggtcaatatttaaaatacttgagatattttgcttttatttatttcttttgttactaagtcttcaaaatccaatgtgtattttacacttacagaacatctctttttagactggccacatgtagctcagggttactgtattggacagagtggtttcagtttcaagtttttccttggagacatcctacttgaaatttccattctccatgtatctgggtggttggtctatagacttgccactcacagctgtcatcttgagactttctttgcttttcttctctattggatattcagtttcctggatttcaggtcttctcattttcctctagtagttttgttaggtcatggttggtatggcatggttgggatagcgtgttcacacagctatctcgtgagtcatactcctccaatccagcctgctcgcttcccgtgtctgtcatgtagttgtcaccctgctatctctccctccagtttttgcagaaatttcctttgtcttcactcttggtcttcctctcccatcccccatgtatcctatatctttctctttcttggtttatttcatcactcaggtggaaaagatgctccagtggattactgggaaaagggggagcatggatgataaaggtattgagaccttacacgtcagggaatttttttttttttttttttttgagacggagttttgctcttgtccaggttggagtgcagtggcgccaactcggctcactgcaacctccacctcctgggttcaagtgattctcctgcctcagcctcctgagtagctgggattacaggtgcccgccaccacgcccagctaattttttgtatttttaatagagacgaggtttcactgtgttggccaggctggtcttgaactcctacttcaggcaatccacccacctcggaatgtttttattgtcccttctcatttcatgactgctgggctaggtatagaattccagaatcattgttcttagaatctcgaaggcattgcttcattgctggccagctttcagtgttcttgcaaagtctgaagctgtgctaatcacctcatcctttgaaagtgaactgttttttcttcccagaaacttacagaacattctctttgtccgcagaattctgggattgcaattactgtgccttagaatgggtctgtttttatcattatgaagagtactggatgggtcgggaggttttcttgaattacttcttgatgttttctttccttgtatttttttgtttgctaattttctatttttttttcttggtttactttcttgggcagggggatttcttctacttatatttgattcttcagttgagcttgtcatttttgctatcttgtttttaagtttcgagagacatctttgttttatataacattctgttcttaatacatagatgcaagatcttttctttctgagtatattaatatgtatttgaaatctttctattctctgcagtttgtttcccccaagggtttttttttttttctggtttttgttttttgtttttatgttagagactttcctgttatatctggtcatcagtggtacctgcatgtggtggagagtaggggcttattggagtatgagaaccttgagcaggtgtaaggagcctgtcaacactgcgctggcctcagggcctctagggaggctgccagttgtgcattctgaggataccttttggttgtgccttttgtctggtcagattatctagagatgctctgcctcctacctggaggagaagggtctagctgccagcggtgtgagtgtctcttggggaaaaggactcgagttcctggtgtttggcttgtgtatggccgcttaccccatttttggtggagcgctcacatcttccactgtgccaacagtcttgctgcagttcatagaccttctggtttacatttttccagaaagtatgtctttagatttctgcagaagtctgaggagcatggaaggagcttggggaatgagatggcaatccaggtcttcccagatggctctacctttatcccctgcagggaatcccactcctccttcctgactgggagcacagccagagccttgggaggaatctggagtggaaatctcgggcggtctggctttcttactgttcacttgtaattttgctttctcacaactgccaaccactaatcagcctgatttccagcttccagaattctattgctgttgtctgctctcctattcccaccgtaggggatggggctgtctttttttttttttttaattttggtaaaacatacaaaacataaagtgttccattttagccatttttaggtacacagttcagtggcagtaagtacattcacgttgtgtgtatttgtttttttagtaataaacaatataaaattttttaagtaataaaacacaaataaaagattgtttaatgtgattatcgtggaattttaggtgtgatcaggagccatggtgtagtcttctgttgaaacagggtgataggatttgtttaccacctcctaggaaagcagttggatagtttgttggcataaaagtacattttatctatttttaataatcgtagctttatagaaattgcagttggaactcccaggcctggcattcaaggctctctgagatctgggctacccacccatgtcctccagccgtctgtcgcacctcctactgcccactcactgttcctggcatgagatgtgatctccagcccccatgcctttgctgtgcagggtgttccagagtgaattgtccctcctgtctgtctctctgccctcttcctcgtctttccatcttcctgccccacatcactgcctcctacccaaggcctgtgctcattcctcctcggttttcccccatggcctggtacatacctctgaattatcaccttgcatttcccatattgcccggctctctttgatgtctgtttctttgctgggtcttcctcagtgtctgacggtcagttaaatgtctttattcttttttgtaggatatccgacatgaagccagtgacttcccatgtagagtggccaagcttcctaagaacaaaaaccgaaataggtacagagacgtcagtccctgtaagtatccacgtggccggtaccagtcttgctcttcctttgctgcaggcctttttagtcaagactcctttcgcctcagggtttagtataataataaatcaatgtagcagaggtttatgacgcgattgtttcctatagtaaaggcattagagacttatagtaatagctcatttttccaccattatagaagggctcaggtttcagtttctggaaaattcagtgaagttcaaagcacttttcttaagctttgactgtttttgtgatgaatcattttcctaccagctgaagcagagtatagcaggcataataaaaccttttctggatgactcagcagcagcgtcattagggcatgagcactgtgttccgctgtaatgaagccccgcacaggcattcggggtgggcactgtcgtcccctgcgctgaatatgcaaggcagctctgtctggagtccccaccgcctccacccccgccaacctcatcatttttctccctctttcctgctgttagttcttcctaggattgtcagtgtgcctgctggcctgtggcagccctgtccgccttctgagtgattggctgtcagtctgccggtagctgaaaagtaaataacttaacatgttagaatttgcataaagtaaggaaaactggagctgagtacaggacttgaactgcgccatctcctctaggccacagaggcctttttgacccccttccaggtctttagacattgtcaggcagtgaggggtcgtagctgccagtgtctccatggtagcgtgctctgccagggatgcagaagattctccagtcattcctccagtgggcacttcctgcaggtcctgtgcccatggctgggagtggtggctgtcattgttctctgccagaagggttagcagtgcatcctgacctgacttatgtggcgcccagattcctggaaggggtctaaaaatggacctagacttggtgtagaacgtgtgcctcttggcctgccaccatggttccctgcctggttttgtgtgtcagctctgccgcttaagaactgagtggcttcgggcaagttgttctctctcataggagtgtgtgaagatgaagcaacataagctgcttagcccagcgcccagtacctcacgcagacataagtgctcagtaaatgttgtctgtggtggggatggttgtcaccaacatctgaagtgcacttctaggtcatcaggtgacatgattggcgccaacacatggtactcttgatttagcacatctcagctgaggcacctcattgatatttgtttaaaaacaaaaacaaaaaaccttggtgattctgctgtgaagtcctggccagaaacctccagaccgctgatcaacacgcaacagaaccatcaccgttcacctctttgacatggtgccaggataccctggatctctagcttttgctatagttgctctaattagggaataatcttgtctttaatattcctttgctacattttttaacatttcttatctaaatggttttatgaatcagttttacagagaaaaaaaaccagtatttaaaatattcttccaggggctggtccaagtacagtagtgtttacaactatgtgatcacaaccagttacagatttctttgttccttctccatccccactgctttacttgactagccaaaaaaaaaaaaaaaaaaagttattccagggaaacaattctccaactttttcactcccaatctcactcctcttatcttcctcccgtactcctatcctcctcccgtactcctatcctcctcccctactcctatcctccagtagaaacagtcatttgctgtgaaggttatgggggagaatgagtcaaggtagaaggtcacctgctgcccagctcacagtgctgctggtgatgacagcagtccacagttacaggcacttgctgaacgaggggctctgtatacacctcagctcattgactcttcccacaaccctcttgtcacctaccatttagcaaatgaaaaaaccaaggctctgaggtgagttgtttgcccagagtcacccagtgctgtttgaacccactcacataaccaaccaataccattatgtaatttttgaggtcttttatctctgtgatccacttaaaaattatccaagtatctttatttgtactaagcctccataatgagaaacagtgttccagatggtggctagttttcaaagacatctctctttggaattcttctttagaacaaaaagccccagaccacttatccccattcatatcccctttggacctagggagaaggtactatttataggtgatcacctgagtttattgtcccttgtgctgtgccagaaataaaggtccccacctgctcttattagctctactaacaggataaggaaagtggccctcagagagctactgcttttgtgacaaacaaatgatacaagaaaaaaaaagtggctttttaattttagtgacctggggcaggacttccaaatgaaagtttatttctaaaaactaaaaggtaaatttaatatactttcagtgtttgggcttaaattctctttcaagtgtctttgtgatatgctctgaattttaaaaatttagaatcattgaagttcattatacttgaactttaaaaaaaaaaaacaaaaacctcgtataaaggtcaaggtatgacttcatgctgctgtgtacttaggtcatttaatcttcaaaccactggatagaggttaggttgaagttcgatcttaaatcctacctactgtagctcattgtaccagcaacagctgtagggactaggtggaattcatggtgggttttgttcccttttaaagattgaagccaccatattttctgccctctaaaagtttatgtcagccaggcatgggtggctcacacttgtaatcccagcactttggggaggctgaggtgggtggatcacttgaggccaggagttcgagaccagcctggccaacatggtgaaaccccatctctactaaaaatagaaaaattaggtgagcatggtggcctgcgcctgtaatcccagctactcgggaggctgaggcaggagaaacatttgaatccgggagatggaggctgcagtgagctgagaacatgccactgcactccagcctgggtgacagagtgagactcttgactcaaaaaaaaaagttatgcatcagagaacagatcctttgatgccctcctctgccctgaaaggtttttgggggagagtaataagtatcacaacaagatatgacctgagaacagatttcccagataggacatgatccatgttttaatatggcttactgctgttgcttcatagtgtgaagcttcagacacttctgaaaaccctttcagaaaatcccagtcgccccatactgatgactaatctcaactaaaacagggcttcagccagtgtgaatgccactaatgccaccaactcacctttgcttttctgtagggtgtgcacctgtatgtacacattcagcttttccgggattaacctctgagttctggtttgtctttcagttgaccatagtcggattaaactacatcaagaagataatgactatatcaacgctagtttgataaaaatggaagaagcccaaaggagttacattcttacccaggtaagcagattgtctgaattttctatttaatgtcaatttaagagtttgagagtgctgttatccacacctcaaataaaatctgccacatcctttagaaggtcaggatttcagcataccaaaaagcagcaaggaagggggaaaaatcatccttcaaaggttcagtttggttataaggaacgctaatcttttctgggaagcataagatgacattgctggaaatgagagcttatagaaaacaacattaaaatgccagagttgcctgtgtggtctgttggcagagacagcagagccatggctggaggagggtctgtacctgtgttgcttccagaagtatttgtcgtagagcacttgtgatggcaaatctaagaacgttagcagtagaccaggaatctctgtccagagccattcagagtagctcagcatggttctcattctttggccagaagaaaggcatcattggatcatgtgaacaagcatgaaaaatgacttaaaatttctgttggcttttggcatctttatggaaacaaaatcctgaaagtggtttaataattgagcctcttgtaaaacactcagtggcatgtgaccaaaagggtatctgggaaagaggataaaaagagtttctttttaattaatcttctcaagtcttaacttgttacctgtaagttggtctaaaaagactgggtttcttattttgtttttcatcataatttttgtttctcattccatgtcagctttcagtcttatatggctttaggccacagggcgattttgaacatttgtaattttgcttaataattaggaaattaaaattctggggaagacagaatgctctatgaagaaaggctgctttgagcaaggagctaggtcagggcgcgttcaactgaggcctttcttcactgcctttttgtcttgtcccagttcctccccatttatgactaaaatcagcccagatgcttctcgtcatctgggatgcagagcatcagcccagctgtgttcagtcctatggggccattgagtaagttcttggtgcatggatacagggcaggcctttaccaggccctgagcccctggtcctcccagcacctctggggtatttaggggaggctgatgggggagggggttgataaggcgggagatgtctggggatgaggttgaggcaaaagtgacttcttgaggactttgctttttggagaagtcaaatttcctacttcttgatttcagcccttcaactctggtatggagtcaggaagccctttaaatacctgttgtcgggtgtatcatgtcaagtgttgcattagcaaatgaccatgtatccttgtgctactgtcctgcctaccccgcatcctagcgcttccttgggacatgagaagctctgtctggtttgtgaggtggcactggggatgttgagaaactgtttacacagtttccctttgccctggggatttactaaaggagtcgaggcagcctgaccccaaagcatcacccctggacactatgaccgaaacatttccccagtgcccaaaccaagaacacccttcccatttttttttcagtggtgttcattatgtaataatacaagtctctcttctcattttttaaaagtcagaagtacagaagagcagagaataatgtccaaggggccctccttcacctcccccgtgcagtgtcagctaagtgtggtgcgtgtccttgcagatcttaggggattgtgatccttcagaccattctaaactggggtggtgctgggagttagggaaggcatgaagggagtagtggagagctgcagtgactggggtcttcatgccagggtggagaatgcaaggcccaggtggccagccatgtgccacgggatttctggctgccaagagctgtttatctgttcactggggagggaagagttaaatgtggtctgcttttctccgagtcccttcagcacagggagtgctgacttgtcttgttcaggtagtaagttcaagatgagctcaggaaagaaagtgagaggacactgagggctagtggttgagccaagtgtgatgggacttaaagggagaagatttaaagaataaggagcttatgggccggggacggtggcttacgcctgtaatcccagcactttgggaggctgaagcaggtggatcacttgggtcaggagttcgaggccagcctggccaacatggtgaaaccccgtctctactaaaaatacagaaattagctgggtgtggtagtgtgcacctgtaatcccagctacttgggaggctgagacaggagaatcgcttgagcccaggaggcagaggttgcagtgagccaggattgcgcccctgtactccagcctgggtgatggagcgagactctgcctcaaaaaaaattaaaaaaaaataaagaggttaggtgaaaatagatgagaatggaaaccatgagaagaagtgatgctggccaaggacatgacaggttctgatgtggaggtgataggcaatgtctcttccagccactgctaataattgagacaaactcaaggcattcataccctgtgtccagtaaacatctgtgcccattgccaggtgagctggattgaaatgggccagctgctcagcagacaccctcatgccccagtgactctgttccccttgggccacctcattgaccatttatgtttctacatctcctaagtttgttgggccaaggatggaggctgtctgccgtcagggtcctcattgctgatggtaggaatagttgctgatgtttcattggatgttgctgtattctagggactgtgctaagtactttatagaaatgaacatacttcattttcacagttttatgaatagggactattattagtcaagtaagcgatggggaaactggggcagggagcgatgaagtgacttgcgcaaggtcacaagatgatgtgattggaaccaagagaagtgttgtggttggccacgcccccacactgcctctcatctgcaccaaggagttttgtcccatagcccaagggccttggggacgaatctcagtggaggcccttagcgggcctgcctgagccagaaagcagaatcggcatttttctgtccttggttggcccagccctgaactgagatgcggaaatcgcctttcgctgcctggtagaaaatggagctgcagttactgaccaccaggcagagagaggtgggtccctgtcccagcctcagccaccactctgcctaagctgtggggactgagggcgctgtcgttagctgactgcagaaggtgagcacacgctgtagcatgttatgtttcagatgtcacatgttgtgttattgtgtctttgcagggccctttgcctaacacatgcggtcacttttgggagatggtgtgggagcagaaaagcaggggtgtcgtcatgctcaacagagtgatggagaaaggttcggtaagtctcggcttcatttgctgtgtatgtgatcatgcataccactccatatagttaccattttcgtccagatttttaaattatttttcttgcctttgtatttcctttacgtagtatttttatttaaaaaaattaaaacagcagcatataaatgcatgttggttgtcaaccagttaatgaagtgaataaaagggaggaggcggaagaactgcacggacctcttcgcccccgccttctcctgtgtggtgcgtgtggcgctccgcccacctgtgctgcctgtgcggctctcatcacagtgtggagttgtgtgtggagttatggagacctgcttttatcttgaaaagcaagttcttagtgcatcttcatggtgtctgattttttggctggtgagagtgtggctacctctgcggagctgtgggagcggctgactagatgagatttgcctccattcagtacctagactcttgccctgccacacctcttcggagtgagcattgacttcaggatgtgtgtcattctaagttcctgcaacttttcaaacacccctcgggctagcgtgtggctgcacggtgtccatttgtgcaggccaccactcctcttgcatctgggtctagccacctctccttcttgacttaccatagttcattttgtaccatgctttcagaatgagctttctcaaatccaagtctcaccacggttcttcccagctgaaaacccttgtgcggttccctttgcctcacaggataatacatggtgtggcttacggaaccctgcaggtctggccctaggcccctggacacagacctctcaccactcttggaactttagccaggacaaagttttctgtttttagtttcttaccatgttctctgggccgaggagtcccagtgcccacgttcatcccacttgcaggcacccctggacggctgcccccagctccccaactgcctgcattctcccctgccctcctcactctgttggaatagctgagaatagccgatttctgggcagccggcctcctgtgtagactgtcctgtgtagactgtcctgtgtagattgtctgtgtagactgtcctgtgtagattgtctgtgtagactgtcctgtgtagactgtccatgtaaactgtcctgtgtagattgtctgtgtagactgtcctgtgtagactgtcctgtgtagattgtctgtgtagactgtctctgtagaccgtcgtgtatagactgtcctgtgtagactgtctctgtagaccgtcgtgtatagactgtcctgtgtagactgtctctgtagaccgtcctgtgtagattgtctgtgtagaccatcctgtgtagaccatcccatttagaccatctgcctgtgcaggcgcaggccagtgttcagcagggccacaggctcctcggcctccctgccctcgctgctccccaacactgccaaccctgctgcggggtccaggaggagatgggctgaggatcgtggagaccagcaggagcgtgtggcccaggagcagggaactgggtgtccttgggccttgccaggtccaggctcagctaggacacggctctcacagctgtcctggttgcctccggccacagaagaaggtgagggctccagagaggccacctttccaaaaaaagcacagtcatggccctagaatgtaaaaaatccaagtgttaagaaggaacacatcaaaggaaacttcagcagtgaaaacttgaagcattaaccacgaagcctctgcctccaccacacacaaagaaacggctttagttactcgcagaaagtcttcctcttaggacagcgcgtgtttaaaatcataggggtttggtttgttttgttttggggttggggttttttgggggttttttacccttgcctactttttaaaaaatgaaagtgtttatttgcccaacaataacagacagggagcttgcctaagtgttctgttgatgatataatgtatcttgtcttagaaaaaaactttttcagtgaaaggtggtttttaaattttttcttccctccttagtagcttgattagtaaaatgtgaagttacaaatgtgaagcaaacccccacccttcaccactagtcagcaattttgagtaaagaaacaaagcatcaggtgctcacagcacacactgtcttagagggaaggggaagcctggtggcctgtggaagccttcagcatagctccatctgcaggcttctgaccctcagcactactgacacttgggctggatcattgtctgctagggatccgggcagggagtggctgtgctgggcgctgtaggaagtttagcagcatctctggcctctatccaccagatgccagtagcaccccctccccagatgtggcagtcagatgtgtttctgtctagactccagactttgtccaacgtcccctggtaggccaaattgcccccggttgagaaccaccgctctagatggtattgagggttgggaattttaaatcaagacatttattcagaaattaccagatatagtagcatttgcttcttatttatttctttgttgctaagtgtttggcaaaacctctttgctgtgagcacaaggtttgctttagcaattgttgtcacattacagcaaggagtggtgtccagcgctgtagttatgtatttgagcagtgtccagtgctgtagttatgtgttccagcctcaccaggccctgtgcttcattgtctcccactcaagactgaccacaaatggcccacagatccactgtgacaacctttccctttgggttactgtggtggcatcgagaacatggctggttggctttgctgtagtttactgtgataactgtgccagcagtccctgctttcctttgttaagtatcccattccactggaggattacttgggcgtgcagattggcatgaaaagcaatgtatggtttgagattgttaaagtttctttgggatcaacattttcaattctgtatcagcattatccctcccagagggctggctgggagaaatcatgagaagttacagtatcttatttgctcagctaatctaattataaatgatccacacagcttgtggtaaaaccagcttttggggagttttcatttaatgcatacttgtcttctgatttccttccttcaccaaatagtgtaggatgctccctcttatttttggcaaacatgcctgttatcttttgggaccctgggcttcctggaaaccagttatgcagaagatgattgtgtgtgttagactggggtcatccagatggctagagttctcactggttctgtttaaggattgactttagacacctcagtgtaggctgcaccatggcgtaagggttgggattgttgtttagaagggggaagtaagcaaggtgagtttaattggccattgcagaatctcacccgtatctccctcctgaaatcctcactaaagctgccgtttgctttcaggtgctttcatgcacaagacactgcattttgtatcacagggtccatataattcatttttctctcgtacttagttctctgtgttaagaattacttacttagttctctgtgttaataatttttggcgaaaccaaattacccgtcacagggttactgtagatgtctttcataggttttccaaacaccacttgcccacttgtttgggaaggccccaaggactgtttaacatctgccttcatggtggaaacagcaactatgagagatgctagcatgttggcactgccatgttcctctggtaccagcccaagataggactcaatttgaggcctggtgaagtactgtgttctaataaaaatccatctacttttcatggccgtatatatcaatgtaatagggtaactggaaatgtgatcttgtgccttttaaaaattttgtgtgtttaaaacaaaaatttctattggaaatgacagagcatagcttgttgctgtagacacctgagagtccttaaaaataaatattgggttattgacacttagttgcatgacagaattcctcacttgtacagttccaaagtcttagtctttacccagattacagagggttattaagcattaggtttggttttgaaagtgagtgcttgctgtctggaggtgagctttaagactcgtctgccctgcttatgagatgaggaagggtggcctcttcctcctgcatttctgttcttcgcttccttctctgtctgctcactctgtggaatgcccaccccagcacgggtggggtggaacctgtcagatcagtctcttgtttctggggtcttgaggcattataagatctagttgttagaagtgtgggattaattcatcttttcacattcttctaagttcctgcttttagctgccacacccactttggctaagtgggggtcttgccatgtaattagcgcctccatgccaagtggcagaattgcttcaatggtgacagattgtccccattcaagagttcacttttggcaactcatcattgatccaggaaggtgacatggatgaaactggctaagacttcagacaggcttgtgtccagactcttgagaaagctctgttggcttctggtctggcactgtgaagtttgctgtgatgctggcaccacaacctggtgtttcctaatttgtttctcccacattttgctttggttttgtcttttgggcagcttccagctccagtagagcaggaccaataggcatttgtggttctatattcaccctcctcacgtgcttcctggctcctcattgcccccagatgatgccacaggtccctgggcctgctgccagtcgtctgtgatctgggcctctgctggccccttctccagctgctcttttcagcctcttatttgcagtcactgcctaggaaatcctagtcatccttcaaaacctgcctcttgcacagagctttctctgatctctcttttctgtaaccttggctgacctgaaacatttccctcttctgaattcctgctgcatgtccgtagcatttccccctcagccctcccccatagtccaccttgtcactgctgggcacagcagtgtcttctgacagacagctggccctgaagtggttcccttcacccacaccatcctttgccccagaggaggtattgagtgggtcagtgcacgtgaactgccagtgtcatttgccaaagagctgttgacacacgctgacatttcttttgctgaaaatcataagggctttgagcttccctctgtccaggcacatggtcaggctgacccggtagctctgcccctgctgacctgccatttttgtccacaacagttatccatgagcagaaacatttgtgtaactgaggcagaaacttagttcaagtaaaatgtcactaaattcgagtcagtttttgtcttagaccctaaatgaaaccaaattttcataaattttcttgttttaaagaaaaatttaatgagctacatttaaactgagaacatcagatagtgtctgagattatcaaaatagaacatcaaaagtatttttctgaatgaactgaaccaaaccagaatgaaagggcaagccctggggagcctgtctccaagccttctctgaaagggagtctgtatttggtgataactgctcagcctctccaaagggcctcacctgctgtctctcccagttttatttttaattgcctgtgagttttctgtgcagggtaaggcacctacattctatgccagcagcctgatcaggtcctgggtaatgtttgaaatggctacacagaggagtttcaaagccttttgttcaatctggcttcacctcgtagacggtgagaaagcgtcagagccctgcaggatcccgttgccacgtttgaccggggagccgatgggtttggaagtctgagccctgtctgcacaacctgccccggtcagcagcttcgtgcccccacccccatctccccatgaggcaggcatctgtgctgaccatggcttccatgttcagaaacccccaggcctttgagttatcatgaagcttgtgggatgtgctccaagcctcctgccatagaaaaactgccatattgctcacaataattcactattatttgtttccccagttaaaatgcgcacaatactggccacaaaaagaagaaaaagagatgatctttgaagacacaaatttgaaattaacattgatctctgaagatatcaagtcatattatacagtgcgacagctagaattggaaaaccttacagtgagtatagcacacacttcagcacttcaggcggctactggttcacatgcctcttcctttatcccttgggtgatattacctaatgtcagtgttcctggcttttgtataccccgagcaagatgtggtttgggcactgtggtgagcggagcttacttgtgtacctaccaagtgcccagggagggtggaggccacagtgctctctctgacctttaacaacagttaacaccagttcttagggaaaggagagtttcttacccaaaagactggttcctgcttgtgcagctgcagagggactggagcggcagcctgcaagtcccagtgaagcatgctgccttctttgtggtcctcagtcttcgagtctgaagagagggaagaaggggtataggggctcactccagtttcatagctagtgaaagttttctgggccaggtcttgggtttttttgttgtgggaagagtttataacaccagctacttgcttggtaaaagttggtcttggaacatggcaaggcattgtggcaagcagcactgccgctgaacgcgctgctcctggggctttggaataattcccctggatccgtaacttgggggtgttcatgtcattctggggaacagtggagggagtgcgcggcagcacctgggggcaccagtgaagagtggccagccaccaacctctagaacctaactggggtcgaatcctggccccaccttactagctcatcacagtgtctccgtttcctcttctgtcaaactcaggttttgcgagggttctgggaggtcctatacgggaagggttagcagttaccatgggtgtgtagcacgggctttatctgaagggaaggtggagccgtagggagaccatgtggagtggggctccagggctgtgtgggtggggagggatctgcttctgggttaccccatgcctccccttctcaagtactactttttaatcatcatggctcctgccattcatttcatagttgatgtaagccaggtgcggtggctcacgtctttaatcccagcacttggggaggctgaggccaggaggatcactcgaggccaggagttcaagaccagcttgggcaacatagtgagacccccgtctctacaaaaaaacaaaaacagttagtcagacatcgtggtgctcccctatagtccagctactcaggaggctgaggcaggaggattgcttgtgcccgggagttcaaggctgcagtgagctatgcttgcaccactgcactctagcctgggtgacagagcaagaccctgtctcaaaaataaataaataaaaaaaatagtagaagtaagatctagaatgtagcacaggttaccaggacgtaggcaaggggttcgggctgcctggctcttgaggatggtagcagtgcagctgatgtgagtgctttctgccctctggtggtgaccgcgccggagtcaccagccctgccatagccctgatggggcagagggttctgagtacggtggatggaggtgctttctggaagattctcaggagtaacatgggcagtgtgttggaatgtgctagaggatttatgcagtagccttttaaaagaatgctttttagcatttgcaagcctgacattaagagtgacttctgggaaactatttgcttgttgagggaaactgaatttcaacagagcagaagagctgtgcgctttttgcttggcagagtgaatacagccagctcagaggttttgatgttaggatctgtttgctccaacagactttgtttttaaaaggcttttctcagccatagctgtctgttctagcacaaggctggaatgagttccttgtgaaagaggtgagcaggtgtgagggagggtgtcagtgggcggtaacccacaccttcaaggattaaaggaaaacttgcatttggcatgcttgcttcttattcaattttaaaatacattttaacggccgggcacggtggctaacacctgtaatcccagcactttgaggggctgaggtgggtggttcacgaggccaggggttcaagaccagcctggccaagatggtgaaaccccatctctactaaaaatacaaaaaaaaaaaaaattagccgggcgtggtggcgggcacctgtaatcccagctactcgggaggctgaggcagagaattgcttgaacccaggaggcggaggttgcattgagccgagatcatgccactgcattccagcctgggcggcagagcaagactctgtctcaaaataataataataattttttaaaaatacattttaagtccttttcttccccacctgcctccacccaccaaatagaagaggtatttcttcttctttaatgtcattaaggttatatggataccattttctagagaggaaagaatgatggaattgcctagtgtgagtctagcaattatcctaacatacacaaatttctccttgttctgtgccaagatactgtatttaatatttaatgaacattaaatattatttactagtgtatttaatggctgaggcagggttaaatatgtattattttcatcccagcagagttgggggaggtcctagtaactatgccatgagctctgtgagggtgaggtggtgtctttgcccccgcctccctggcacagtgactggcacatgattggcatagtgtggacattcgtcaagtgaaggaaggcatcatgagcagatctctggcctgaatccttctgccatcagctgctcgccaggtggccctggcactgggccacagggaaactctccaggctggtatggttcctgtctgtggctgtcttcccgggcccatgttaggagactttcacttccagagccctttccctctcagggccttgcttaccaagtgactggttcccatttactaggagctcttaggtcattgaagatgttgcgtactccccccagtgagggctgccttttgatcacagccgccagaagcctcaaggaaggagcagagctggaaacagacgccaggccattgcttctgttcctctggggcagacccagccacggaagagacattctgggacaagggctggggtccacctttcaaacgtgtctgcagcaggctctcagcatggactctctgcctccaaacatccacctcctcatcggaaaatggatgggagtgcctgcctggagcagctggtgggagagcgcagcgccagcacgtaggacacactcggttcatgggctgatgccgttcgcattgactgcctcttcagctgggtgttgagccacaccttggagtcaccagtctttggagaccaagtctgctacttttttctctaaagtgacaatcctctgaaacctccagatcatcttgaagcccccgtctgaaagttgcccagagccagtgcctcacctgctgttccttgttcactttttcacgggaggccttgcagggctttatgacaagattttatgggtggctgcccagcatcattgtgactcgtgagacagagagaaaccagttgtaaccatgtagacagtggaagtgatagggagaaaagaggtgaggggactcttcaatccgaagggaaatgaagtctaagcaggcgcaccctgcaggttcagtgtcaagcccagggcctggccccagggtgtggtatttgttgactgggtgtgtggaccctgggagaaagtctgagaatgaatgttcctcttagaggtagagagtggaaggtgactctgtgtgtacttggaattagtgatttctgtacagatgattcttttagaatcatcatgagtatttttctctttcagacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctggtaaggaggccctcgcgggtgccctggggagctcctctacctgctctgctgtgatgttttttcctaagtagaaactgaagcgctcctcttccaaaatacagagactcactgtgttagtctgtttttgcgttactaataaaggcgtacctgagactcggtaatttgtaaagaaaagaggtttaactggctcccggttctgcaggctgtacaagcatggcaccagcatctgctcggctcctggggaggcctcagggagcttccagtcatggtggaaggtgaaggggagcaggagcaagagatgggggaggtcccagactcttaaccagctctcttgtgaatgcattgcctcagggagggcaccaagcctttcatgagggacctgtccccctgacccagacacctcccacccagccccacctccaacactagggatcacatttcagcatgagattgggaggggacagacatctaacggtgttattaacgttgcccttgagaattggacctggctgacttatatctcctctctggctttcagatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggtcagcattgcctttgtttgaatccaggtgtgaccattttaacttttttgtctttgaaggaggctgtcagttgtaaaagttcaaacaccgtctggtgtcaggggaaatagctacccttcatgtttaaaatagctagaaagttgtcaaaatgttcaccatgttgcactttgtgcctttgaagtgctcacatagagagcattgataggaagacgagactttattttcaaaagatttcatcttccaagtacatggctgcagccctgagaggccgagagcccctcgccaagccgtcacctctgctcatgcaaagggatttcctgacaaaccagccgaagtgaacactaataggacttcctcttgctgctctttcaaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaaggtaatatgattgggtcccagcttgttggggtgaggggaaatgactttctgttctagaaacacacgctggtactgaaaccctgtggatgcagcctcctgttggcaagcagcgcttccgcatccttggggaacagggcgcgtggaccacagccactccactcctggctgctggaggtccggtattgggcacagggtggccgcaggacatgagccacttctgtgggcttctagtgccaccttgtggtgcttgttggaatgaggggctcggagccaccgagtagggtttttctgccccccctgacgacagcgccctcccccaggtttccggacagtcctgaaatgtgatgtccaggcttgagtgccctcagtccccacagtggtcctttggggaatgtaaccttttttatgtggtcttgattaaatcccattttacttccttgcaggttaacaaccattattgagtacctattgatatgtgtggtgtactgagttaactagaacatgtcccctggtctgtgttctagaccatcttgctgggaaaaaggcagacccaaagcatattttggtgggggcccatggacagtgatgtgatagaggtgtccgctgaggtggtcagggaaggctgcttgcagtaggtggccgtgcacggaaagtttgcagaatgagcaggtgttagttccagctggagatgactgccggctgtgcccttggtacctgctttctggagggaagttttaagacgtgtgcatacttgacccagcagttgtatacatggagaaatttactttgcagcaactctcaaaacaagcgtgtaaagatgtgtataggtagttgtgtttgttgtggcattgtttgtagtagtgaaaaattagagacaggccaatgatataaccagggacctgatcaattatgttctctcccggtgttgggatattctgtagctcttaaagaatgagatctgggtgtactgatgtggccagacattgcaattgcagtacatgagaaggcaaatcatacagtagtgtgtacaccagtgagtcctccagccagataaatcctcacagtgaccagtcgcccaggcaccttgtgaaccctaccctgggtgtgggtgctatctgaagtacctgggggagggggtgacaagtggacttcaggctgatgtgggccctggcctggccctccctccaagcagagggggctggctcgctggaaggttaacatcatccaactctgtctacacgtggcttgttttttcctagaattcctgccacaatagcagcatccttgccattcattttctccaaagtgagtaacccatctctgccctctgattcctcagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacagggtatgtttccactgacagacgcgctggcgagatgctcgtgtgcagagagcactggccgctagcccgatggtaggattcagttctgtggtgcatctgagccagtctcagaagaaacagatcaaaggtttttaaagtctggaactgtggaagggctaacaagagaattaaggatcgatgcactggggttttaaggagccctctggtcccaagaatataagagtctaatctcagggccttaacctattcaggagtaagtagagaaaatgccaaatacgtctgtttctctctctctttttttttttattcctttgtttttggaaaaaaatagagttacaacacattgttgtttttaacctttataaaaagcagctttttgttatttctggaacaaaaaaaaacaaagtaggcacttatgaaactttctcatacccttaggtgatgtaatcagccatataatttatatttgatttcccagggaaggaatcccaaacttttacgaatgtaaactcccttggagaagagggttaggacgctgttgcgctcaagcccccctcagctgtgtgcacactgagccaggacagggtctttgagctttcccactataagaagaacagcaacaaaaggccgtctagaaaaacagaacctgcctctgcttctgctcagggtgtccccgctgggtttccattgtcctttctccattgctccctcctgtgacagccatcttgctcatgtaccagccctcatcaccccatccccataaatgggtgtcctcgaggcctctgcctgggggtcagaggtcaccacagggtggccattggcatgtcaacccgctgttaattcagagaagtgggctccacctcattgggagaagtgccatttcagcagaaattcacacgttagacgtgtgttgctgttaagtaaggggaagagagaggactagcctcagagctctggccatggaaatgacctcctaagactttttcgtggttttaaatattttacctctttccaggtggcatctgagtacatcagatggttttgcaaaatgcaaacaattttttccttggggatgatttttggggagagggggctactgtaaaaaataaaaccaaaaccccctttgctccctcggaggttgaagttgccggggggtgtggccggggtcatgcatgaggcgacagctctgcaggtgcgggtctgggctcatctgaactgtttggtttcattccagttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaaataaaaacaaaaaaagcaaggtgttttggtataataccttttcaggtgtgtgtggatacgtggctgcatgaccgggtgggtgggggggagtgtctcagggtcttctgtgacctcacagaactgtcagactgtacagttttccaacttgccatattcatgatgggtttgcattttagctgcaacaataaaatttttttctaaagaacatgaatttggggtgcttcccatttttttctttgcttaatagagctaaaccaggatgagtaactcctgtttctttctatccctgctgatgtgaaacagatgttgtcaatcagctggggttagagttttccacttctaagaattaacctcagcatccctgcattgccagcaccctcaggctggagcgctttccttgactgtgagcttgttgaacaccttaggcctcagcccatttccttcccaaattgacgctttgcctgtgtagggccctcagataacttaacaaacttaccagtgttgtttgaagaacagtgttttgagttgtaatctcaaaaccatatcccttacccaattacctgtaagacacaatggttaccacatctcagtacgtaaagtccacttgatatagaattgacttagaaataagacagattagtatagtttttcatttgtgtacaaaattaaacaatgtaaattccccccaaagtgatttttttgactttttgaagtaattttggacttgcaaaatgttgccaaaatagtacgaagagttccccagtaccctcgaagtttcctcgactgtttcaaagctggctgcaggcccaggctcatgagactgggaagaggacaggctgtggtcatgtggacccacaggggcctggggctgcagaagtcagtgtggcttccaccatttcaggtataaaaaagggcatctaagctttcaagaagagggaggatgctctagggcagcggtccccaaccttttctggcaccaggaaccggttccatggaagacaattttttcacaggcctgggggtggtgagggatggttttgggatagaaacttccacctcagatcatcaggcatcagattctcataaggagcttgcaacctgatctcttgcacacattcagttcacaatagggttcacgctcctaagagaacctgatgctgcagctgatctaacaggagatggagctcaggtggtcatgctcagtcgctcgccactcacctcctgccatgcagtccagttcctaacaggcctcagaccagtaccggtctgtggcctgggggttgaggacccctgctctaggctggtactgctgatgcttaaaaagagagggtttgccagaaatcagatgggacaaaagggcaaaggccgtgccacagagtgcccatataggggagagcacgcctggagccttcgagagcatgcagagaagcctggagactgcatttaccggagctgctgcctgaggccaccctccaagtgtccccacagcgcaccacaagaccacaggagtgacctcctcactggcaggtatttggggaaacaactgctgtctactcttttgggtaaaaagtgaaacaccaatagtttaattgaaatttcagaaaattgaacatatgaacaaggcaaataaatactaagtaagttaaaaacacaaaatatgtccaggaagtatcgatgagaatgttcaagttaaagttctccaatgccattgctacagcaacctcaaaccctaggttctctctgcactattaacacagacatctcaggacatggtttgcttttttttaagacttaaataggaaactaatttttctttctttaaagcaattgcgttcttcagtgaactctttctttaggccagttgatggcttcttagcagtttattgacgagatcctagggtagcttccgaagctgggttgattgattgcatttgggtgcggatggccaaagtgagtggccctactgcctgtgctgctcagggctcctgggctgatgtggtggct

SEQ ID NO: 15 - DNA, 4978 bp, homo sapiens
ggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtaaaaa

SEQ ID NO: 16 - DNA, 938 bp, homo sapiens
gttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgagggacttctcctccagtggacctgaaggacgagggatgggatttcatgtaaccaagagtattccatttttactaaagcagtgttttcacctcatatgctatgttagaagtccaggcagagacaataaaacattcctgtgaaaggcacttttcattccactttaacttgattttttaaattcccttattgtcccttccaaaaaaaagagaatcaaaattttacaaagaatcaaaggaattctagaaagtatctgggcagaacgctaggagagatccaaatttccattgtcttgcaagcaaagcacgtattaaatatgatctgcagccattaaaaagacacattctgtaaaaaaaaaaaa

SEQ ID NO: 17 - DNA, 16 bp, Artificial sequence
  Synthetic oligonucleotide
ttgatttaatggttgc

SEQ ID NO: 18 - DNA, 16 bp, Artificial sequence
  Synthetic oligonucleotide
tgatttaatggttgca

SEQ ID NO: 19 - DNA, 16 bp, Artificial sequence
  Synthetic oligonucleotide
gatttaatggttgcaa

SEQ ID NO: 20 - DNA, 16 bp, Artificial sequence
  Synthetic oligonucleotide
agtcgcgactctggta

SEQ ID NO: 21 - DNA, 16 bp, Artificial sequence
  Synthetic oligonucleotide
gtcaatatcaaagcac

SEQ ID NO: 22 - DNA, 16 bp, Artificial sequence
  Synthetic oligonucleotide
gaacattattaggcta

SEQ ID NO: 23 - DNA, 16 bp, Artificial sequence
  Synthetic oligonucleotide
ccttatggatgctgct

SEQ ID NO: 24 - DNA, 16 bp, Artificial sequence
  Synthetic oligonucleotide
cattgtactatgccag

SEQ ID NO: 25 - DNA, 20 bp, Artificial sequence
  Synthetic oligonucleotide
tgctccgttggtgcttgttc

SEQ ID NO: 26 - DNA, 20 bp, Artificial sequence
  Synthetic oligonucleotide
tcttcctgtgacagtggtgg

SEQ ID NO: 27 - DNA, 20 bp, Artificial sequence
  Synthetic oligonucleotide
ttcttcctgtgacagtggtg

SEQ ID NO: 28 - DNA, 20 bp, Artificial sequence
  Synthetic oligonucleotide
ggttcttcctgtgacagtgg

SEQ ID NO: 29 - DNA, 20 bp, Artificial sequence
  Synthetic oligonucleotide
cgactatgcgagtgtggtgt

SEQ ID NO: 30 - DNA, 20 bp, Artificial sequence
  Synthetic oligonucleotide
ccgactatgcgagtgtggtg

SEQ ID NO: 31 - DNA, 20 bp, Artificial sequence
  Synthetic oligonucleotide
gcctcagtctgcttcgcacc

SEQ ID NO: 32 - DNA, 20 bp, Artificial sequence
  Synthetic oligonucleotide
agcttcttgtccagctttat

SEQ ID NO: 33 - DNA, 20 bp, Artificial sequence
  Synthetic oligonucleotide
agcatagttaacgagctccc

SEQ ID NO: 34 - DNA, 20 bp, Artificial sequence
  Synthetic oligonucleotide
tgtcatattcctggatcctt

SEQ ID NO: 35 - DNA, 16 bp, Artificial sequence
  Synthetic oligonucleotide
ggacacccacgccccc

SEQ ID NO: 36 - DNA, 20 bp, Artificial sequence
  Synthetic oligonucleotide
ccctcctgtgcctggatgct

SEQ ID NO: 37 - DNA, 16 bp, Artificial sequence
  Synthetic oligonucleotide
gctaaacaaccgcctt

SEQ ID NO: 38 - DNA, 20 bp, Artificial sequence
  Synthetic oligonucleotide
atgcatggtgatgcttctga

SEQ ID NO: 39 - DNA, 16 bp, Artificial sequence
  Synthetic oligonucleotide
catggtgatgcttctg

SEQ ID NO: 40 - DNA, 16 bp, Artificial sequence
  Synthetic oligonucleotide
agagctaaacaaccgc

SEQ ID NO: 41 - DNA, 16 bp, Artificial sequence
  Synthetic oligonucleotide
actcccgggacaccca

SEQ ID NO: 42 - DNA, 16 bp, Artificial sequence
  Synthetic oligonucleotide
acaccctcgcctccgg

SEQ ID NO: 43 - DNA, 16 bp, Artificial sequence
  Synthetic oligonucleotide
gcctccggaacaccca

SEQ ID NO: 44 - DNA, 20 bp, Artificial sequence
  Synthetic oligonucleotide
acggcattggtgcacagttt

SEQ ID NO: 45 - DNA, 20 bp, Artificial sequence
  Synthetic oligonucleotide
gcaaccgggatgatgagtgc

SEQ ID NO: 46 - DNA, 20 bp, Artificial sequence
  Synthetic oligonucleotide
tgcacagtttctggcaggcc

SEQ ID NO: 47 - DNA, 20 bp, Artificial sequence
  Synthetic oligonucleotide
ggcagcggacggcattggtg

SEQ ID NO: 48 - DNA, 20 bp, Artificial sequence
  Synthetic oligonucleotide
ggtgcacagtttctggcagg

SEQ ID NO: 49 - DNA, 20 bp, Artificial sequence
  Synthetic oligonucleotide
gcagccatggtgatcaggag

SEQ ID NO: 50 - DNA, 20 bp, Artificial sequence
  Synthetic oligonucleotide
ggtagaaatatagttgttcc

SEQ ID NO: 51 - DNA, 20 bp, Artificial sequence
  Synthetic oligonucleotide
ttcatgtgtctgcatcatgt

SEQ ID NO: 52 - DNA, 20 bp, Artificial sequence
  Synthetic oligonucleotide
gcatccagcgagcaccaaag

SEQ ID NO: 53 - DNA, 20 bp, Artificial sequence
  Synthetic oligonucleotide
agccatggtgatcaggaggc

SEQ ID NO: 54 - DNA, 20 bp, Artificial sequence
  Synthetic oligonucleotide
cagccatggtgatcaggagg

SEQ ID NO: 55 - DNA, 20 bp, Artificial sequence
  Synthetic oligonucleotide
gtctggattacagcataaac

SEQ ID NO: 56 - DNA, 20 bp, Artificial sequence
  Synthetic oligonucleotide
ggtctggattacagcataaa

SEQ ID NO: 57 - DNA, 20 bp, Artificial sequence
  Synthetic oligonucleotide
ccttggtctggattacagca

SEQ ID NO: 58 - DNA, 20 bp, Artificial sequence
  Synthetic oligonucleotide
ccttggtctggattacagca

SEQ ID NO: 59 - DNA, 20 bp, Artificial sequence
  Synthetic oligonucleotide
gtgcttgtccaggatgatgc

SEQ ID NO: 60 - DNA, 17 bp, Artificial sequence
  Synthetic oligonucleotide
ggttcccgaggtgccca

SEQ ID NO: 61 - DNA, 20 bp, Artificial sequence
  Synthetic oligonucleotide
tccacaggccacaggtgggc

SEQ ID NO: 62 - DNA, 20 bp, Artificial sequence
  Synthetic oligonucleotide
ctctttattgttggaggaca

SEQ ID NO: 63 - DNA, 20 bp, Artificial sequence
  Synthetic oligonucleotide
gcaaggctcggttgggcttc

SEQ ID NO: 64 - DNA, 17 bp, Artificial sequence
  Synthetic oligonucleotide
gggcaatgcagtcctgg

SEQ ID NO: 65 - DNA, 17 bp, Artificial sequence
  Synthetic oligonucleotide
gaaggtgacaccagcct

SEQ ID NO: 66 - DNA, 17 bp, Artificial sequence
  Synthetic oligonucleotide
gctcagcatccacaggc

SEQ ID NO: 67 - DNA, 21 bp, Artificial sequence
  Synthetic oligonucleotide
gggttcccgaggtgcccaatg

SEQ ID NO: 68 - DNA, 20 bp, Artificial sequence
  Synthetic oligonucleotide
gcagaggtgaagcgaagtgc

SEQ ID NO: 69 - DNA, 20 bp, Artificial sequence
  Synthetic oligonucleotide
aatggtttattccatggcca

SEQ ID NO: 70 - DNA, 20 bp, Artificial sequence
  Synthetic oligonucleotide
ggtttattccatggccattg

SEQ ID NO: 71 - DNA, 20 bp, Artificial sequence
  Synthetic oligonucleotide
aaatggtttattccatggcc

SEQ ID NO: 72 - DNA, 18 bp, Artificial sequence
  Synthetic oligonucleotide
aatggtttattccatggc

SEQ ID NO: 73 - DNA, 16 bp, Artificial sequence
  Synthetic oligonucleotide
ctatttggatgtcagc

SEQ ID NO: 74 - DNA, 20 bp, Artificial sequence
  Synthetic oligonucleotide
tcttggttacatgaaatccc

SEQ ID NO: 75 - DNA, 20 bp, Artificial sequence
  Synthetic oligonucleotide
cttggttacatgaaatccca

SEQ ID NO: 76 - DNA, 20 bp, Artificial sequence
  Synthetic oligonucleotide
ggaatactcttggttacatg

SEQ ID NO: 77 - DNA, 20 bp, Artificial sequence
  Synthetic oligonucleotide
tggaatactcttggttacat

SEQ ID NO: 78 - DNA, 20 bp, Artificial sequence
  Synthetic oligonucleotide
ttttattgtctctgcctgga

SEQ ID NO: 79 - DNA, 20 bp, Artificial sequence
  Synthetic oligonucleotide
gaatgttttattgtctctgc

SEQ ID NO: 80 - DNA, 20 bp, Artificial sequence
  Synthetic oligonucleotide
aggaatgttttattgtctct

SEQ ID NO: 81 - DNA, 20 bp, Artificial sequence
  Synthetic oligonucleotide
acaggaatgttttattgtct

SEQ ID NO: 82 - DNA, 3731 bp, Homo sapiens
gtccgatggggctctggtggcgtgatctgcgcgccccaggcgtcaagcacccacaccctagaaggtttccgcagcgacgtcgaggcgctcatggttgcaggcgggcgccgccgttcagttcagggtctgagcctggaggagtgagccaggcagtgagactggctcgggcgggccgggacgcgtcgttgcagcagcggctcccagctcccagccaggattccgcgcgccccttcacgcgccctgctcctgaacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggccttgaagttgccccatgtcgactacatcgaggaggactcctctgtctttgcccagagcatcccgtggaacctggagcggattacccctccacggtaccgggcggatgaataccagccccccgacggaggcagcctggtggaggtgtatctcctagacaccagcatacagagtgaccaccgggaaatcgagggcagggtcatggtcaccgacttcgagaatgtgcccgaggaggacgggacccgcttccacagacaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtcatcacagttggggccaccaatgcccaagaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggttggcagctgttttgcaggactgtatggtcagcacactcggggcctacacggatggccacagccgtcgcccgctgcgccccagatgaggagctgctgagctgctccagtttctccaggagtgggaagcggcggggcgagcgcatggaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaaggggccgtgacagccgttgccatctgctgccggagccggcacctggcgcaggcctcccaggagctccagtgacagccccatcccaggatgggtgtctggggagggtcaagggctggggctgagctttaaaatggttccgacttgtccctctctcagccctccatggcctggcacgaggggatggggatgcttccgcctttccggggctgctggcctggcccttgagtggggcagcctccttgcctggaactcactcactctgggtgcctcctccccaggtggaggtgccaggaagctccctccctcactgtggggcatttcaccattcaaacaggtcgagctgtgctcgggtgctgccagctgctcccaatgtgccgatgtccgtgggcagaatgacttttattgagctcttgttccgtgccaggcattcaatcctcaggtctccaccaaggaggcaggattcttcccatggataggggagggggcggtaggggctgcagggacaaacatcgttggggggtgagtgtgaaaggtgctgatggccctcatctccagctaactgtggagaagcccctgggggctccctgattaatggaggcttagctttctggatggcatctagccagaggctggagacaggtgcgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttcacagaggaagaaacctggaaccagagggggcgtgcctgccaagctcacacagcaggaactgagccagaaacgcagattgggctggctctgaagccaagcctcttcttacttcacccggctgggctcctcatttttacgggtaacagtgaggctgggaaggggaacacagaccaggaagctcggtgagtgatggcagaacgatgcctgcaggcatggaactttttccgttatcacccaggcctgattcactggcctggcggagatgcttctaaggcatggtcgggggagagggccaacaactgtccctccttgagcaccagccccacccaagcaagcagacatttatcttttgggtctgtcctctctgttgcctttttacagccaacttttctagacctgttttgcttttgtaacttgaagatatttattctgggttttgtagcatttttattaatatggtgactttttaaaataaaaacaaacaaacgttgtcctaacaaaaaaaaaaaaaaaaaaaaa

SEQ ID NO: 83 - DNA, 20 bp, Artificial sequence
  Synthetic oligonucleotide
ccttggccacgccggcatcc

SEQ ID NO: 84 - DNA, 20 bp, Artificial sequence
  Synthetic oligonucleotide
gtcacacttgctggcctgtc

SEQ ID NO: 85 - DNA, 20 bp, Artificial sequence
  Synthetic oligonucleotide
tggcagtggacacgggtccc

SEQ ID NO: 86 - DNA, 20 bp, Artificial sequence
  Synthetic oligonucleotide
actcaccgagcttcctggtc

SEQ ID NO: 87 - DNA, 20 bp, Artificial sequence
  Synthetic oligonucleotide
atcccacgcccctgtccagc

SEQ ID NO: 88 - DNA, 20 bp, Artificial sequence
  Synthetic oligonucleotide
ggacattgccagtaatcgca

SEQ ID NO: 89 - DNA, 20 bp, Artificial sequence
  Synthetic oligonucleotide
tgcaagtctcttggcaaaca

SEQ ID NO: 90 - DNA, 20 bp, Artificial sequence
  Synthetic oligonucleotide
agcatagattttgacttccc

SEQ ID NO: 91 - DNA, 20 bp, Artificial sequence
  Synthetic oligonucleotide
ccacctttgggtgaatagca

SEQ ID NO: 92 - DNA, 20 bp, Artificial sequence
  Synthetic oligonucleotide
actcaacttgaggacaataa

SEQ ID NO: 93 - DNA, 16 bp, Artificial sequence
  Synthetic oligonucleotide
agctgaaggcaaccag

SEQ ID NO: 94 - DNA, 16 bp, Artificial sequence
  Synthetic oligonucleotide
agagttgacatgggca

SEQ ID NO: 95 - DNA, 16 bp, Artificial sequence
  Synthetic oligonucleotide
ccagtagtcaatatta

SEQ ID NO: 96 - DNA, 16 bp, Artificial sequence
  Synthetic oligonucleotide
ctcaacttgaggacaa

SEQ ID NO: 97 - DNA, 16 bp, Artificial sequence
  Synthetic oligonucleotide
agtatattcagtccaa

SEQ ID NO: 98 - DNA, 16 bp, Artificial sequence
  Synthetic oligonucleotide
tggcaagcatcctgta

SEQ ID NO: 99 - DNA, 16 bp, Artificial sequence
  Synthetic oligonucleotide
ctcaatccatggcagc

SEQ ID NO: 100 - DNA, 16 bp, Artificial sequence
  Synthetic oligonucleotide
accaagtttcttcagc

SEQ ID NO: 101 - DNA, 13 bp, Artificial sequence
  Synthetic oligonucleotide
gcattggtattca

SEQ ID NO: 102 - DNA, 20 bp, Artificial sequence
  Synthetic oligonucleotide
ttcagcattggtattcagtg

SEQ ID NO: 103 - DNA, 16 bp, Artificial sequence
  Synthetic oligonucleotide
cagcattggtattcag

SEQ ID NO: 104 - DNA, 15 bp, Artificial sequence
  Synthetic oligonucleotide
cagcattggtattca

SEQ ID NO: 105 - DNA, 14 bp, Artificial sequence
  Synthetic oligonucleotide
agcattggtattca

SEQ ID NO: 106 - DNA, 12 bp, Artificial sequence
  Synthetic oligonucleotide
gcattggtattc

SEQ ID NO: 107 - DNA, 14 bp, Artificial sequence
  Synthetic oligonucleotide
tgctacaaaaccca

SEQ ID NO: 108 - DNA, 16 bp, Artificial sequence
  Synthetic oligonucleotide
cccattgtcacactcc

SEQ ID NO: 109 - DNA, 18 bp, Artificial sequence
  Synthetic oligonucleotide
cggcatgtctattttgta

SEQ ID NO: 110 - DNA, 20 bp, Artificial sequence
  Synthetic oligonucleotide
ggctaaatcgctccaccaag

SEQ ID NO: 111 - DNA, 20 bp, Artificial sequence
  Synthetic oligonucleotide
ctctagcgtcttaaagccga

SEQ ID NO: 112 - DNA, 20 bp, Artificial sequence
  Synthetic oligonucleotide
gctgcatgatctccttggcg

SEQ ID NO: 113 - DNA, 20 bp, Artificial sequence
  Synthetic oligonucleotide
acgttgaggggcatcgtcgc

SEQ ID NO: 114 - DNA, 20 bp, Artificial sequence
  Synthetic oligonucleotide
cggttagaagactcatcttt

SEQ ID NO: 115 - DNA, 30 bp, Artificial sequence
  Synthetic oligonucleotide
ctccaacatcaaggaagatggcatttctag

SEQ ID NO: 116 - DNA, 23 bp, Artificial sequence
  Synthetic oligonucleotide
  misc_feature (12)..(12): n is a, c, g, or t
gaatattaacanactgacaagtc

SEQ ID NO: 117 - DNA, 21 bp, Artificial sequence
  Synthetic oligonucleotide
  misc_feature (9)..(9): n is a, c, g, or t
  misc_feature (19)..(19): n is a, c, g, or t
cgttgatanttctgccatnct

SEQ ID NO: 118 - DNA, 19 bp, Artificial sequence
  Synthetic oligonucleotide
gccatggttttttctcagg

SEQ ID NO: 119 - DNA, 20 bp, Artificial sequence
  Synthetic oligonucleotide
cctgccctttgttctagttg

SEQ ID NO: 120 - DNA, 19 bp, Artificial sequence
  Synthetic oligonucleotide
gggtctgcagcgggatggt

SEQ ID NO: 121 - DNA, 21 bp, Artificial sequence
  Synthetic oligonucleotide
gttactacttccacctgcctg

SEQ ID NO: 122 - DNA, 25 bp, Artificial sequence
  Synthetic oligonucleotide
tatccggagggctcgccatgctgct

SEQ ID NO: 123 - DNA, 21 bp, Artificial sequence
  Synthetic oligonucleotide
gtcgccccttctccccgcagc

SEQ ID NO: 124 - DNA, 18 bp, Artificial sequence
  Synthetic oligonucleotide
ggaccctcctccggagcc

SEQ ID NO: 125 - DNA, 23 bp, Artificial sequence
  Synthetic oligonucleotide
accaggcgtctcgtggggcacat

SEQ ID NO: 126 - DNA, 18 bp, Artificial sequence
  Synthetic oligonucleotide
tctcccagcgtgcgccat

SEQ ID NO: 127 - DNA, 15 bp, Artificial sequence
  Synthetic oligonucleotide
gtgctccattgatgc

SEQ ID NO: 128 - DNA, 20 bp, Artificial sequence
  Synthetic oligonucleotide
tcccgcctgtgacatgcatt

SEQ ID NO: 129 - DNA, 21 bp, Artificial sequence
  Synthetic oligonucleotide
cagcagcagagtcttcatcat

SEQ ID NO: 130 - DNA, 20 bp, Artificial sequence
  Synthetic oligonucleotide
gggacgcggcgctcggtcat

SEQ ID NO: 131 - DNA, 20 bp, Artificial sequence
  Synthetic oligonucleotide
ccacaagctgtccagtctaa

SEQ ID NO: 132 - DNA, 20 bp, Artificial sequence
  Synthetic oligonucleotide
ccgcagccatgcgctcttgg

SEQ ID NO: 133 - DNA, 20 bp, Artificial sequence
  Synthetic oligonucleotide
tcagggcattctttccattc

SEQ ID NO: 134 - DNA, 20 bp, Artificial sequence
  Synthetic oligonucleotide
cgaaggaaacaatactccga

SEQ ID NO: 135 - DNA, 20 bp, Artificial sequence
  Synthetic oligonucleotide
gacagcagccgcagcagaaa

SEQ ID NO: 136 - DNA, 20 bp, Artificial sequence
  Synthetic oligonucleotide
tggaaaggcttatacccctc

SEQ ID NO: 137 - DNA, 20 bp, Artificial sequence
  Synthetic oligonucleotide
tcaaggaagatggcatttct

SEQ ID NO: 138 - RNA, 16 nt, Artificial sequence
  Synthetic oligonucleotide
guggcuaacagaagcu

SEQ ID NO: 139 - RNA, 25 nt, Artificial sequence
  Synthetic oligonucleotide
uuugccgcugcccaaugccauccug

SEQ ID NO: 140 - DNA, 18 bp, Artificial sequence
  Synthetic oligonucleotide
  misc_feature (5)..(14)
  misc_feature (5)..(14): bases at these positions are DNA
gcgugcctcctcacuggc

SEQ ID NO: 141 - DNA, 21 bp, Artificial sequence
  Synthetic oligonucleotide
agcttcagtcatgacttcctt

SEQ ID NO: 142 - DNA, 20 bp, Artificial sequence
  Synthetic oligonucleotide
gcttcagtcatgacttcctt

SEQ ID NO: 143 - DNA, 20 bp, Artificial sequence
  Synthetic oligonucleotide
cagctttattagggacagca

SEQ ID NO: 144 - DNA, 14 bp, Artificial sequence
  Synthetic oligonucleotide
tcagtcatgacttc

What is claimed:

1. A compound comprising an oligomer and a conjugate group having Formula II:

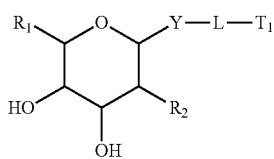

wherein:
$R_1$ is selected from $CH_2NJ_1J_2$ and $CH_2SJ_3$;
$R_2$ is $N(H)C(=O)$ $Q_2$;
$Q_2$ is methyl;
Y is O;
L is a connecting group comprising a linear alkylene group optionally including one or more groups independently selected from O, S, $NJ_7$, $C(=O)$, a phosphorus linking group and a cleavable bond or L is a single bond between Y and $T_1$;
$J_1$, $J_2$, $J_3$ and $J_7$ are each, independently, H or a substituent group;
$T_1$ is said oligomer; and
each substituent group is, independently, mono or poly substituted with optionally protected substituent groups independently selected from halogen, $C_1$-$C_6$ alkyl, $C_1$-$C_6$ alkoxy, aryl, heterocyclic and heteroaryl wherein each substituent group can include a linear or branched alkylene group optionally including one or more groups independently selected from O, S, NH and $C(=O)$, and wherein each substituent group may be further substituted with one or more groups independently selected from $C_1$-$C_6$ alkyl, halogen and $C_1$-$C_6$ alkoxy wherein each cyclic group is mono or polycyclic.

2. The compound of claim 1 wherein $R_1$ is selected from $CH_2NJ1J2$ and $CH_2SJ_3$ wherein $J_1$, $J_2$ and $J_3$ are each independently selected from H and $CH_3$.

3. The compound of claim 2 wherein $J_1$, $J_2$ and $J_3$ are each H.

4. The compound of claim 1 wherein L optionally comprises one or more amides and wherein L attaches to $T_1$ through a group selected from among:

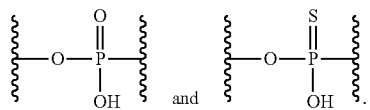

5. The compound of claim 1 wherein L comprises a phosphorus linking group, $NH_2$, or $N(CH_3)_2$.

6. The compound of claim 1 having the configuration:

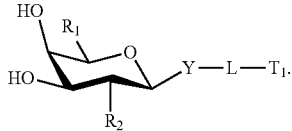

7. The compound of claim 1, wherein the oligomer comprises at least one modified nucleoside comprising a modified base and or a modified sugar.

8. The compound of claim 7 having at least one modified nucleoside comprising a modified sugar selected from a bicyclic nucleoside and a 2'-modified nucleoside.

9. The compound of claim 8, 4'-C(CH$_3$)H-O-2' or 4'-CH$_2$—O-2'bridged bicyclic nucleoside.

10. The compound of claim 8, comprising at least one 2'-O(CH$_2$)$_2$OCH$_3$ substituted 2'-modified nucleoside.

11. The compound of claim 1, wherein the conjugate group is attached to the 5'-terminal nucleoside of the oligomer.

12. The compound of claim 1, wherein the conjugate group is attached to the 3'-terminal nucleoside of the oligomer.

13. The compound of claim 1, wherein the oligomer has a sugar motif comprising:
a 5'-region consisting of 2-8 linked 5'-region nucleosides, wherein at least two 5'-region nucleosides are modified nucleosides and wherein the 3'-most 5'-region nucleoside is a modified nucleoside;
a 3'-region consisting of 2-8 linked 3'-region nucleosides, wherein at least two 3'-region nucleosides are modified nucleosides and wherein the 5'-most 3'-region nucleoside is a modified nucleoside; and
a central region between the 5'-region and the 3'-region consisting of 5-10 linked central region nucleosides, each independently selected from among: a modified nucleoside and an unmodified deoxynucleoside, wherein the 5'-most central region nucleoside is an unmodified deoxynucleoside and the 3'-most central region nucleoside is an unmodified deoxynucleoside.

14. The compound of claim 1, wherein the oligomer comprises at least one modified internucleoside linkage.

15. The compound of claim 1, wherein each internucleoside linkage of the oligomer is independently a phosphodiester or a phosphorothioate internucleoside linkage.

16. The compound of claim 1, wherein the oligomer has a nucleobase sequence comprising an at least 14 or 16 nucleobase portion complementary to an equal length portion of a target nucleic acid.

17. A pharmaceutical composition comprising a compound or oligomer according to claim 1 and a pharmaceutically acceptable carrier or diluent.

18. The compound of claim 1 comprising an oligomer and three conjugate groups having Formula II attached to said oligomer through a single connecting group.

* * * * *